US012545734B2

(12) United States Patent
Whitfield et al.

(10) Patent No.: US 12,545,734 B2
(45) Date of Patent: Feb. 10, 2026

(54) CHIMERIC ANTIGEN RECEPTORS THAT TARGET MOLECULES ON DISEASE-ASSOCIATED MACROPHAGES AND METHODS RELATED THERERTO, AND TREATMENT OF FIBROTIC, INFLAMMATORY AND AUTOIMMUNE CONDITIONS

(71) Applicant: THE TRUSTEES OF DARTMOUTH COLLEGE, Hanover, NH (US)

(72) Inventors: Michael Whitfield, Etna, NH (US); Patricia Pioli, Etna, NH (US); Charles Sentman, Grantham, NH (US); Jake Reder, Hanover, NH (US); Joana Murad, Grantham, NH (US); Yolanda Nesbeth, Bethesda, MD (US)

(73) Assignees: CELDARA MEDICAL LLC, Lebanon, NH (US); THE TRUSTEES OF DARTMOUTH COLLEGE, Lebanon, NH, US, Hanover, NH (US)

( * ) Notice: Subject to any disclaimer, the term of this patent is extended or adjusted under 35 U.S.C. 154(b) by 853 days.

(21) Appl. No.: 16/639,836

(22) PCT Filed: Aug. 20, 2018

(86) PCT No.: PCT/US2018/047101

§ 371 (c)(1),
(2) Date: Feb. 18, 2020

(87) PCT Pub. No.: WO2019/036724

PCT Pub. Date: Feb. 21, 2019

(65) Prior Publication Data

US 2020/0369773 A1 Nov. 26, 2020

Related U.S. Application Data

(60) Provisional application No. 62/547,184, filed on Aug. 18, 2017.

(51) Int. Cl.

| | |
|---|---|
| ***A61K 40/11*** | (2025.01) |
| ***A61K 40/22*** | (2025.01) |
| ***A61K 40/31*** | (2025.01) |
| ***A61K 40/41*** | (2025.01) |
| ***A61K 40/42*** | (2025.01) |
| ***C07K 16/28*** | (2006.01) |

(52) U.S. Cl.

CPC .......... *C07K 16/2851* (2013.01); *A61K 40/11* (2025.01); *A61K 40/22* (2025.01); *A61K 40/31* (2025.01); *A61K 40/416* (2025.01); *A61K 40/4202* (2025.01); *A61K 40/4215* (2025.01); *C07K 16/2878* (2013.01); *A61K 2239/28* (2023.05); *C07K 2317/569* (2013.01); *C07K 2317/622* (2013.01); *C07K 2319/02* (2013.01); *C07K 2319/03* (2013.01); *C07K 2319/33* (2013.01)

(58) Field of Classification Search

CPC ................................ A61K 35/17; C07K 16/28
See application file for complete search history.

(56) References Cited

U.S. PATENT DOCUMENTS

| | | | |
|---|---|---|---|
| 5,968,735 A | 10/1999 | Stein et al. | |
| 9,556,273 B2 * | 1/2017 | Van Ginderachter | A61K 47/6829 |
| 11,365,391 B2 * | 6/2022 | Sentman | A61P 37/06 |
| 2005/0256207 A1 | 11/2005 | McGrath et al. | |
| 2016/0096902 A1 | 4/2016 | Cooper et al. | |
| 2016/0361630 A1 | 12/2016 | Sudit et al. | |
| 2017/0296623 A1 * | 10/2017 | Juillerat | A61K 39/395 |
| 2020/0078399 A1 * | 3/2020 | Fan | C07K 14/70596 |

OTHER PUBLICATIONS

Yu, S. et al., Chimeric antigen receptor T cells: a novel therapy for solid tumors. J Hematol Oncol, 2017, 10: 78, 1-13. https://doi.org/10.1186/s13045-017-0444-9 (Year: 2017).*
Yu et al. J Hematol Oncol, 2017, 10(78), 1-13 (Year: 2017).*

(Continued)

*Primary Examiner* — Amy M Bunker
*Assistant Examiner* — Vyoma Shubham Tiwari
(74) *Attorney, Agent, or Firm* — Robin L. Teskin; Baker, Donelson, Bearman, Caldwell & Berkowitz PC

(57) ABSTRACT

The invention provides chimeric antigen receptors (CARs), nucleic acid sequences encoding a CAR, vectors comprising a nucleic acid sequence encoding a CAR, cells expressing a CAR, pharmaceutical compositions comprising a cell expressing a CAR, wherein the CAR binds to a target molecule expressed on disease-associated macrophages (DAMs) or over- or aberrantly-expressed in fibrosis. The invention further provides vectors encoding a CAR and a fibrotic disease-modulatory molecule (FDMM), and cells expressing both a CAR and an FDMM. The invention also provides methods of treating a subject using a CAR, a nucleic acid sequence, a vector or vectors, or a CAR-expressing cell, a cell expressing both a CAR and an FDMM, or a pharmaceutical composition, and to methods of generating a CAR-expressing cell or a cell expressing both a CAR and an FDMM. The invention also provides methods of treating diseases, fibrotic conditions, inflammatory conditions, autoimmune conditions, and conditions associated with DAMs.

8 Claims, 32 Drawing Sheets

Figure 1:
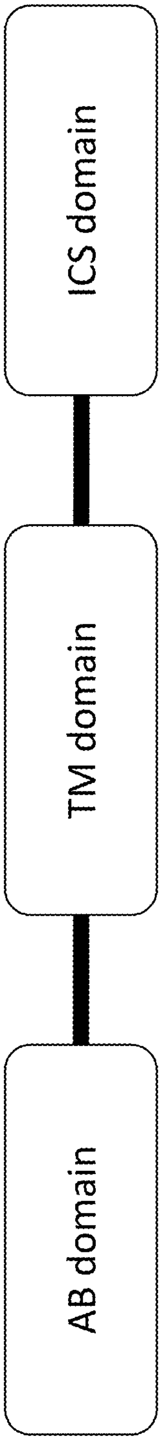

Specification includes a Sequence Listing.

(56) References Cited

OTHER PUBLICATIONS

Kim MG et al. The Role of M2 Macrophages in the Progression of Chronic Kidney Disease following Acute Kidney Injury. PLoS One. Dec. 2, 2015;10(12):e0143961. doi: 10.1371/journal.pone.0143961. PMID: 26630505; PMCID: PMC4667939. (Year: 2015).*
Hudecek M. et al. The nonsignaling extracellular spacer domain of chimeric antigen receptors is decisive for in vivo antitumor activity. Cancer Immunol Res. Feb. 2015;3(2):125-35. doi: 10.1158/2326-6066.CIR-14-0127. Epub Sep. 11, 2014. PMID: 25212991; PMCID: PMC4692801. (Year: 2015).*
Brudno et al. Toxicities of chimeric antigen receptor T cells: recognition and management. Blood. Jun. 30, 2016; 127(26):3321-30. doi : 10.1182/blood-2016-04-703751. Epub May 20, 2016. PMID: 27207799; PMCID: PMC4929924 (Year: 2016).*
Kang, Kyuho et al. "Interferon-y Represses M2 Gene Expression in Human Macrophages by Disassembling Enhancers Bound by the Transcription Factor MAF." Immunity vol. 47,2 (2017): 235-250. e4. doi: 10.1016/j.immuni.2017.07.017.

* cited by examiner

| AB domain construct | Nb MMRm 22.84 | Nb MMRm 5.38 | scFv P4A8VHVL | scFv P4A8VLVH | scFv P3G5VHVL | scFv P3G5VLVH |
|---|---|---|---|---|---|---|
| Target | CD206 | CD206 | Fn14 | Fn14 | Fn14 | Fn14 |
| Type | nano-body | nano-body | scFv | scFv | scFv | scFv |
| AA SEQ ID | NO: 110 | NO: 114 | NO: 141 | NO: 142 | NO: 143 | NO: 144 |
| NA SEQ ID | NO: 210 | NO: 214 | NO: 241 | NO: 242 | NO: 243 | NO: 244 |

| N-terminal side ↑ | | | | | | |
|---|---|---|---|---|---|---|
| AB domain | Nb MMRm22.84 | Nb MMRm5.38 | scFv P4A8VHVL | scFv P4A8VLVH | scFv P3G5VHVL | scFv P3G5VLVH |
| Hinge | CD28H | CD28H | CD28H | CD28H | CD28H | CD28H |
| TM | CD28TM | CD28TM | CD28TM | CD28TM | CD28TM | CD28TM |
| CS | CD28CS | CD28CS | CD28CS | CD28CS | CD28CS | CD28CS |
| ICS | CD3zICS | CD3zICS | CD3zICS | CD3zICS | CD3zICS | CD3zICS |
| AA SEQ ID | NO: 160 | NO: 161 | NO: 162 | NO: 163 | NO: 164 | NO: 165 |
| NA SEQ ID | NO: 260 | NO: 261 | NO: 262 | NO: 263 | NO: 264 | NO: 265 |

FIG 6A

| N-terminal side ↑ | | | | | | |
|---|---|---|---|---|---|---|
| AB domain | Nb MMRm22.84 | Nb MMRm5.38 | scFv P4A8VHVL | scFv P4A8VLVH | scFv P3G5VHVL | scFv P3G5VLVH |
| Hinge | mCD28H | mCD28H | mCD28H | mCD28H | mCD28H | mCD28H |
| TM | mCD28TM | mCD28TM | mCD28TM | mCD28TM | mCD28TM | mCD28TM |
| CS | mCD28CS | mCD28CS | mCD28CS | mCD28CS | mCD28CS | mCD28CS |
| ICS | mCD3zICS | mCD3zICS | mCD3zICS | mCD3zICS | mCD3zICS | mCD3zICS |
| AA SEQ ID | NO: 760 | NO: 761 | NO: 762 | NO: 763 | NO: 764 | NO: 765 |
| NA SEQ ID | NO: 860 | NO: 861 | NO: 862 | NO: 863 | NO:864 | NO: 865 |

FIG 6B

| Construct | pFB. mCAR 2284 | pFB. mCAR 538 | pFB. mCAR 4A8H | pFB. mCAR 4A8L | pFB. mCAR 3G5H | pFB. mCAR 3G5L |
|---|---|---|---|---|---|---|
| N-terminal side ↑ | | | | | | |
| LS | LS | LS | LS | LS | LS | LS |
| AB domain | NbMM Rm22.84 | NbMM Rm5.38 | scFv P4A8VHVL | scFv P4A8VLVH | scFv P3G5VHVL | scFv P3G5VLVH |
| Hinge | CD28H | CD28H | CD28H | CD28H | CD28H | CD28H |
| TM | CD28TM | CD28TM | CD28TM | CD28TM | CD28TM | CD28TM |
| CS | CD28CS | CD28CS | CD28CS | CD28CS | CD28CS | CD28CS |
| ICS | CD3zICS | CD3zICS | CD3zICS | CD3zICS | CD3zICS | CD3zICS |
| AA SEQ ID | NO: 578 | NO: 579 | NO: 580 | NO: 581 | NO: 582 | NO: 583 |
| NA SEQ ID | NO: 678 | NO: 679 | NO: 680 | NO: 681 | NO: 682 | NO: 683 |

FIG 7A

| Construct | pFB. mCAR 2284_t19 | pFB. mCAR 538_t19 | pFB. mCAR 4A8H_t19 | pFB. mCAR 4A8L_t19 | pFB. mCAR 3G5H_t19 | pFB. mCAR 3G5L_t19 | pFB.t19 |
|---|---|---|---|---|---|---|---|
| LS<br>AB domain<br>Hinge<br>TM<br>CS<br>ICS<br>T2A<br>trCD19 | LS<br>Nb MMRm22.84<br>CD28H<br>CD28TM<br>CD28CS<br>CD3zICS<br>T2A<br>trCD19 | LS<br>Nb MMRm5.38<br>CD28H<br>CD28TM<br>CD28CS<br>CD3zICS<br>T2A<br>trCD19 | LS<br>scFv P4A8VHVL<br>CD28H<br>CD28TM<br>CD28CS<br>CD3zICS<br>T2A<br>trCD19 | LS<br>scFv P4A8VLVH<br>CD28H<br>CD28TM<br>CD28CS<br>CD3zICS<br>T2A<br>trCD19 | LS<br>scFv P3G5VHVL<br>CD28H<br>CD28TM<br>CD28CS<br>CD3zICS<br>T2A<br>trCD19 | LS<br>scFv P3G5VLVH<br>CD28H<br>CD28TM<br>CD28CS<br>CD3zICS<br>T2A<br>trCD19 | trCD19 |
| AA SEQ ID | NO: 178 | NO: 179 | NO: 180 | NO: 181 | NO: 182 | NO: 183 | NO: 151 |
| NA SEQ ID | NO: 278 | NO: 279 | NO: 280 | NO: 281 | NO: 282 | NO: 283 | NO: 251 |

FIG 7B

| Construct | pFB. mCAR2284_mt19 | pFB. mCAR538_mt19 | pFB. mCAR4A8H_mt19 | pFB. mCAR4A8L_mt19 | pFB. mCAR3G5H_mt19 | pFB. mCAR3G5L_mt19 | pFB.mt19 |
|---|---|---|---|---|---|---|---|
| LS | LS | LS | LS | LS | LS | LS | |
| AB domain | Nb MMRm22.84 | Nb MMRm5.38 | scFv P4A8VHVL | scFv P4A8VLVH | scFv P3G5VHVL | scFv P3G5VLVH | |
| Hinge | mCD28H | mCD28H | mCD28H | mCD28H | mCD28H | mCD28H | |
| TM | mCD28TM | mCD28TM | mCD28TM | mCD28TM | mCD28TM | mCD28TM | |
| CS | mCD28CS | mCD28CS | mCD28CS | mCD28CS | mCD28CS | mCD28CS | |
| ICS | mCD3zICS | mCD3zICS | mCD3zICS | mCD3zICS | mCD3zICS | mCD3zICS | |
| T2A | T2A | T2A | T2A | T2A | T2A | T2A | |
| trCD19 | mtrCD19 | mtrCD19 | mtrCD19 | mtrCD19 | mtrCD19 | mtrCD19 | mtrCD19 |
| AA SEQ ID | NO: 778 | NO: 779 | NO: 780 | NO: 781 | NO: 782 | NO: 783 | NO: 751 |
| NA SEQ ID | NO: 878 | NO:879 | NO: 880 | NO: 881 | NO: 882 | NO: 883 | NO: 851 |

FIG 7C

| | | |
|---|---|---|
| AA<br>SEQ ID | NO: 136 | NO: 766 |
| NA<br>SEQ ID | NO: 236 | NO: 866 |

| | | |
|---|---|---|
| AA SEQ ID | NO: 196 | NO: 784 |
| NA SEQ ID | NO: 296 | NO: 884 |

21-day model 21-day model

CHIMERIC ANTIGEN RECEPTORS THAT TARGET MOLECULES ON DISEASE-ASSOCIATED MACROPHAGES AND METHODS RELATED THERERTO, AND TREATMENT OF FIBROTIC, INFLAMMATORY AND AUTOIMMUNE CONDITIONS

This application is a U.S. National Phase Application submitted under 35 U.S.C. 371 based on International Application No. PCT/US2018/047101 filed Aug. 20, 2018 (published as WO/2019/036724 on Feb. 19, 2019), which claims the benefit of U.S. Provisional Application Ser. No. 62/547,184, filed Aug. 18, 2017, each and all of which are hereby incorporated by reference in their entirety.

This application includes as part of its disclosure a biological sequence listing in a file named "1156867.001201.txt" created on Feb. 18, 2020 and having a size of 671,496 bytes, which is hereby incorporated by reference in its entirety.

FIELD OF INVENTION

The invention disclosed herein relates to chimeric antigen receptors (CARs), nucleic acid sequences encoding a CAR, vectors comprising a nucleic acid sequence encoding a CAR, cells expressing a CAR, and pharmaceutical compositions comprising a cell expressing a CAR. The invention also relates to the treatment of diseases, fibrotic conditions, inflammatory conditions, autoimmune diseases, and conditions associated with disease-associated macrophages (DAMs). The invention further relates to vectors encoding a CAR and a fibrotic disease-modulatory molecule (FDMM), wherein such CAR and FDMM are on the same or different vectors, and cells expressing both a CAR and an FDMM. The invention also relates to methods of treating a subject using a CAR, a nucleic acid sequence, a vector, or a CAR-expressing cell, a cell expressing both a CAR and an FDMM, or a pharmaceutical composition, and to methods of generating a CAR-expressing cell or a cell expressing both a CAR and an FDMM.

BACKGROUND OF THE INVENTION

Inflammation can send signals to the body to help the immune system eliminate pathogens or undesired conditions. However, inappropriate levels or altered types of inflammation can cause numerous physiological or immunological complications within the body. Such inflammation can be directly responsible for the pathology of various diseases including autoimmune diseases, fibrotic diseases, chronic infections, and allergies (Laria, A. et al., "The macrophages in rheumatic diseases", *J Inflamm Res.* 2016 Feb. 9; 9: p. 1-11; Wynn, T. A., and Ramalingam, T. R., "Mechanisms of fibrosis: fibrotic translation for fibrotic diseases", *Nat Med,* 2012 Jul. 6; 18(7): p. 1028-40; Yang, Z. P., Kuo, C. C., and Grayston, J. T, "Systemic dissemination of *Chlamidia pneumoniae* following intranasal inoculation in mice", *J Infect Dis.* 1995 March; 171(3): p. 736-8; Jian, Z., and Zhu, L., "Update on the role of alternatively activated macrophages in asthma", *J Asthma Allergy,* 2016 Jun. 3; 9: p. 101-7). Inflammation can also indirectly exacerbate the symptoms of or play an assisting role in the pathogenesis of many diseases, including cancers, obesity, metabolic diseases, and cardiovascular diseases such as atherosclerosis (Coussens, L. M., and Werb, Z., "Inflammation and Cancer", *Nature* 2002 Dec. 19-26; 420(6917): p. 860-7; Monteiro, R., and Azevedo, I., "Chronic inflammation in obesity and the metabolic syndrome", *Mediators Inflamm.* 2010; 2010; Libby, P., "Inflammation and cardiovascular disease mechanisms", *Am J Clin Nutr.* 2006 February; 83(2): p. 456S-460S).

Inflammation is a combination of physiological responses mediated by various cell types, proteins, humoral factors, and tissues. Macrophages (MPs) are one of the key regulators in inducing, sustaining, and/or exacerbating various types of inflammation in a variety of diseases, including those mentioned above (Laria, A. et al., "The macrophages in rheumatic diseases", *J Inflamm Res.* 2016 Feb. 9; 9: p. 1-11; Wynn, T. A., and Ramalingam, T. R., "Mechanisms of fibrosis: fibrotic translation for fibrotic diseases" *Nat Med,* 2012 Jul. 6; 18(7): p. 1028-40; Yang, Z. P., Kuo, C. C., and Grayston, J. T, "Systemic dissemination of *Chlamidia pneumoniae* following intranasal inoculation in mice", *J Infect Dis.* 1995 March; 171(3): p. 736-8; Jian, Z., and Zhu, L., "Update on the role of alternatively activated macrophages in asthma", *J Asthma Allergy,* 2016 Jun. 3; 9: p. 101-7; Coussens, L. M., and Werb, Z., "Inflammation and Cancer", *Nature.* 2002 Dec. 19-26; 420(6917): p. 860-7; Monteiro, R., and Azevedo, I., "Chronic inflammation in obesity and the metabolic syndrome" *Mediators Inflamm.* 2010; 2010; Libby, P., "Inflammation and cardiovascular disease mechanisms", *Am J Clin Nutr.* 2006 February; 83(2): p. 456S-460S; Murray, P. J., and Wynn, T. A., "Protective and pathogenic functions of macrophage subsets", *Nat Rev Immunol.* 2011 Oct. 14; 11(11): p. 723-37). MPs involved in disease processes, particularly of inflammatory diseases, fibrosis, and/or autoimmune diseases, are often called, for example, alternatively activated MPs, M2 MPs, M2-like MPs, M2a MPs, M2b MPs, M2c MPs, M4 MPs, fibrotic MPs, pro-fibrotic MPs, or tumor-associated MPs (TAMs), depending on the context, function, and phenotype (Murray, P. J., and Wynn, T. A., "Protective and pathogenic functions of macrophage subsets", *Nat Rev Immunol.* 2011 Oct. 14; 11(11): p. 723-37; Chinetti-Gbaguidi, G., Colin, S., and Staels, B., "Macrophage subsets in atherosclerosis", *Nat Rev Cardiol.* 2015 January; 12(1): p. 10-7). These MPs are collectively referred to herein as disease-associated macrophages (DAMs). In contrast to conventionally-activated MPs or M1 MPs that produce TNF, IL-12, or nitric oxide, DAMs as defined herein generally produce cytokines including, but not limited to, IL-6, IL-4, IL-10, IL-13, or TGF-β upon activation (Classen, A., Lloberas, J., and Celada, A., "Macrophage activation: classical versus alternative", *Methods Mol Biol.* 2009; 531: p. 29-43).

DAMs are involved in disease pathogeneses through various mechanisms (Laria, A. et al., "The macrophages in rheumatic diseases", *J Inflamm Res.* 2016 Feb. 9; 9: p. 1-11). For example in asthma, M2a MPs produce IL-4 and IL-13 to induce type 2 T helper (Th2) cells that cause allergic inflammation, while M2b and M2c MPs direct tissue remodeling and fibrosis in the airway (Jian, Z., and Zhu, L., "Update on the role of alternatively activated macrophages in asthma", *J Asthma Allergy,* 2016 Jun. 3; 9: p. 101-7). In cancer, TAMs produce immunosuppressive cytokines to inhibit anti-tumor T cell responses and produce chemoattractants to recruit immunosuppressive cells including myeloid derived suppressor cells (MDSCs), immature dendritic cells (DCs) and regulatory T cells (Tregs) to generate a microenvironment permissive to tumor growth (Coussens, L. M., and Werb, Z., "Inflammation and Cancer", *Nature.* 2002 Dec. 19-26; 420(6917): p. 860-7, Williams, C. B., Yeh, E. S., and Soloff, A. C., "Tumor-associated macrophages: unwitting accomplishes in breast cancer malignancy", *NPJ Breast Cancer.* 2016; 2).

Fibrosis is the condition describing formation or deposition of fibrous connective tissue, characterized by excess accumulation of extracellular matrix (ECM) such as collagen, in an organ or tissue, and can severely disturb the function of such an organ or tissue. Fibrosis is the major pathological feature of many chronic inflammatory diseases including systemic sclerosis (SSc), idiopathic pulmonary fibrosis (IPF), cystic fibrosis, ulcerative colitis, and myelofibrosis, all of which are life-threatening and lack effective therapies that treat the cause of disease (Wynn, T. A., and Ramalingam, T. R., "Mechanisms of fibrosis: fibrotic translation for fibrotic diseases", *Nat Med,* 2012 Jul. 6; 18(7): p. 1028-40). Inflammation is often the direct cause of fibrosis, and MPs play a critical role in the fibrogenic process. In pulmonary fibrosis, they produce and activate the pro-fibrotic cytokine TGF-β to stimulate fibroblast proliferation and activation (Murray, L. A., et al., "TGF-β driven lung fibrosis is macrophage dependent and blocked by Serum Amyloid P", *Int J Biochm Cell Biol.* 2011 January; 43(1): p. 154-62). Such a role of MPs is also suggested in SSc, an autoimmune fibrotic disease with the highest fatality rate among all systemic autoimmune diseases (Taroni, J. N., et al., "A novel multi-network approach reveals tissue-specific cellular modulators of fibrosis in systemic sclerosis", *Genome Med,* 2017. 9(1): p. 27; Johnson, M. E., P. A. Pioli, and M. L. Whitfield, "Gene expression profiling offers insights into the role of innate immune signaling in SSc", *Semin Immunopathol,* 2015. 37(5): p. 501-9). In turn, fibroblasts produce cytokines such as IL-6 and IL-33, as well as CC and CXC chemokines, through which fibroblasts assist the activation and migration of immune cells such as MPs (Kendall, R. T. and C. A. Feghali-Bostwick, "Fibroblasts in fibrosis: novel roles and mediators", *Front Pharmacol,* 2014. 5: p. 123), establishing the reciprocal relationship between inflammation and fibrosis.

A small molecule inhibitor (PLX3397) for colony-stimulating factor receptor 1 (CD115) decreased MP infiltration in tumors and thereby reduced tumor growth in mouse models for neurofibroma, melanoma, gastrointestinal stromal tumors, and malignant peripheral nerve sheath tumors (Binnemars-Postma, K., Storm, G., and Prakash, J., "Nanomedicine strategies to target tumor-associated macrophages", *Int J Mol Sci.* 2017 May 4; 18(5)). In a mouse TGF-β-driven lung fibrosis model, inhibition of MPs using serum amyloid P component (SAP), a member of the pentraxin protein family, successfully diminished all pathologies including airway inflammation, pulmonary fibrocyte accumulation, and collagen deposition (Murray, L. A., et al., "TGF-β-driven lung fibrosis is macrophage dependent and blocked by Serum amyloid P", *Int J Biochm Cell Biol.* 2011 January; 43(1): p. 154-62).

There are several molecules expressed on DAMs, and well-known examples include CD206, CD163, CD204, and CD209 (Jian, Z., and Zhu, L., "Update on the role of alternatively activated macrophages in asthma", *J Asthma Allergy,* 2016 Jun. 3; 9: p. 101-7). CD206, also known as mannose receptor (MR), macrophage mannose receptor (MMR), macrophage mannose receptor 1 (MMR1), C-type mannose receptor 1 (MRC1), or C-type lectin domain family member D (CLEC13D), is a C-type lectin primarily present on MPs, often found on M2, M2a, M2b, and M2c MPs. CD206 is overexpressed on DAMs in many diseases including cancers (Luo, Y., et al., "Targeting tumor-associated macrophages as a novel strategy against beast cancer", *J Clin Invest.* 2006 August; 116(8): p. 2132-2141), and in SSc, CD206 expression is directly correlated with disease severity and mortality (Christmann, R. B., et al., "Interferon and alternative activation of monocyte/macrophages in systemic sclerosis-associated pulmonary arterial hypertension", *Arthritis Rheum,* 2011. 63(6): p. 1718-28).

CD163, also known as scavenger receptor cystein-rich type 1 protein M130 or hemoglobin scavenger receptor, is often associated with alternatively activated, M2, or M2c MPs. Elevated production of CD163 by DAMs is also seen in a variety of diseases, including SSc (Baeten, D., et al., "Association of $CD163^+$ macrophages and local production of soluble CD163 with decreased lymphocyte activation in spondylarthropathy synovitis", *Arthritis Rheum.* 2004 May; 50(5): p. 1611-23; Higashi-Kuwata N., et al., "Alternatively activated macrophages (M2 macrophages) in the skin of patient with localized scleroderma", *Exp Dermatol.* 2009 August; 18(8):727-9.; Higashi-Kuwata N., et al., "Characterization of monocyte/macrophage subsets in the skin and peripheral blood derived from patients with systemic sclerosis", *Arthritis Res Ther.* 2010; 12(4)).

Macrophage receptor with collagenous structure (MARCO) on DAMs has profibrotic function (Murthy, et al., "Alternative activation of macrophages and pulmonary fibrosis are modulated by scavenger receptor, macrophage receptor with collagenous structure", *FASEB J.* 2015 August; 29(8):3527-36), and the role of CD115 in tumor-associated M2 MPs differentiation are also shown (Haegel et al., "A unique anti-CD115 monoclonal antibody which inhibits osteolysis and skews human monocyte differentiation from M2-polarized macrophages toward dendritic cells", *MAbs.* 2013 September-October; 5(5):736-47.). CD11b, F4/80, CD68, CSF1R, MAC2 (or galectin 3), CD11c, LY6G, LY6C, CD169, CD204, and IL-4Rα are also commonly used as cell surface markers to identify MPs (Murray, P. J., and Wynn, T. A., "Protective and pathogenic functions of macrophage subsets", *Nat Rev Immunol.* 2011 Oct. 14; 11(11): p. 723-37; Chavez-Galan, L., et al., "Much more than M1 and M2 macrophages, there are also CD169 ($^+$) and TCR($^+$) macrophages", *Front Immunol.* 2015 May 26; 6: p. 263). CD16, CD14, CD32, CD36 are also expressed on MPs (Martinez, F. O. and Gordon, S., "The M1 and M2 paradigm of macrophage activation: time for reassessment", F1000*Prime Reports.* 2014; 6: 1-13; Benoit, M. et al., "Macrophage polarization in bacterial infections", *J Immunol.* 2008; 181: 3733-3739; Foguer, K., "Endostatin gene therapy inhibits intratumoral macrophage M2 polarization", *Biomed Pharmacother.* 2016 April; 79:102-11.).

Fibroblast growth factor-inducible 14 (Fn14, or FGF-inducible 14), alternatively called TNF-related weak inducer of apoptosis receptor (TWEAK receptor, TWEAKR or TWEAK-R), TNFRSF12A, or CD266, is the only known signaling receptor for the cytokine TWEAK (TNFSF12). Fn14 is expressed on DAMs and has a pathological role. Fn14 expression is observed in advanced human atherosclerotic plaques, especially in infiltrating MP-rich disease sites (Moreno J A, et al., "HMGB1 expression and secretion are increased via TWEAK-Fn14 interaction in atherosclerotic plaques and cultured monocytes", *Arterioscler Thromb Vasc Biol* 2013; 33:612-620), and anti-Fn14 antibody diminishes uptake of lipids by MPs, suggesting the involvement of Fn14-expressing MPs in the pathology of atherosclerosis (Schapira K, et al., "Fn14-Fc fusion protein regulates atherosclerosis in ApoE5/5 mice and inhibits macrophage lipid uptake in vitro", *Arterioscler Thromb Vasc Biol* (2009) 29:2021-7). Fn14 on MPs is also indicated in oxidative stress and associated vascular damage in atherosclerosis (Madrigal-Matute, J., "TWEAK/Fn14 interaction promotes oxidative stress through NADPH oxidase activation in macrophages", *Cardiovasc Res.* 2015 Oct. 1; 108(1): p. 139-47). In patients with multiple sclerosis (MS), Fn14 is expressed on perivascular and meningeal MPs in the disease associated lesions, and it is suggested to contribute to inflammation and tissue injury (Serafini, B., "Expression of TWEAK and its receptor Fn14 in the multiple sclerosis brain: implications for inflammatory tissue injury", *J Neuropathol Exp Neurol.* 2008 December; 67(12): p. 1137-48). Fn14 expression on MPs and its pathological role are also shown in obesity and diabetes (Vendrell, J., and Chacon, M. R., "TWEAK: A new player in obesity and diabetes. *Front Immunol.",* 2013 Dec. 30; 4:488).

Fn14 is also found on non-MP cell types and the significant role of Fn14 is confirmed in the pathology of various diseases. In fibrosis, activation of Fn14 expressed on fibroblasts induces collagen expression and causes fibroblast proliferation and myofibroblast differentiation in vitro, and in Fn14-deleted mice, right ventricular fibrosis is substantially reduced (Novoyaticva, T., et al., "Deletion of Fn14 receptor protects from right heart fibrosis and dysfunction", *Basic Res Cardiol.* 2013 March; 108(2): p 325). In human dermal fibroblasts, Fn14 expression was induced by TGF-β through a TGF-β signaling co-mediator, SMAD4 (Chen, S., et al., "Fn14, a downstream target of the TGF-b signaling pathway, regulates fibroblast activation", *PLoS One.* 2015 Dec. 1; 10(12)). Fn14 is also expressed on bronchial epithelial cells and is suggested to contribute to airway remodeling induced by TWEAK and TGF-β associated with chronic airway inflammation and damage in diseases such as asthma and chronic obstructive pulmonary disease (COPD) (Itoigawa, Y., et al., "TWEAK enhances TGF-b-induced epithelial-mesenchymal transition in human bronchial epithelial cells", *Respir Res.* 2015 Apr. 8; 16:48). Many solid tumors also express Fn14 (Culp, P. A., et al., "Antibodies to TWEAK receptor inhibit human tumor growth through dual mechanisms", *Clin Cancer Res.* 2010 Jan. 15; 16(2): p. 497-508), and increased expression of Fn14 correlates with higher tumor and/or progression in brain, breast, esophageal, prostate, gastric, and bladder cancers (Zhou, H., et al., "The TWEAK receptor Fn14 is a novel therapeutic target in melanoma: Immunotoxins targeting Fn14 receptor for malignant melanoma treatment", *J Invest Dermatol.* 2013 April; 133(4): p. 1052-62). The use of anti-Fn14 antibody reduced the proliferation of several kinds of Fn14-expressing tumor cells through Fn14-mediated signaling and through antibody-dependent cellular cytotoxicity (ADCC) in a xenograft model (Culp, P. A., et al., "Antibodies to TWEAK receptor inhibit human tumor growth through dual mechanisms", *Clin Cancer Res.* 2010 Jan. 15; 16(2): p. 497-508).

Other molecules that are over- or aberrantly-expressed in fibrosis or have a significant role in the pathology of fibrosis include FIZZ2 (Liu, T., et al., "FIZZ2/RELM-β Induction and Role in Pulmonary Fibrosis", *J Immunol.* 2011 Jul. 1; 187(1):450-61), TGFBRI and TGFBRII (Lian, C., et al., "The anti-fibrotic effects of microRNA-153 by targeting TGFβR-2 in pulmonary fibrosis", *Exp Mol Pathol.* 2015 October; 99(2):279-85.; Wang, B., et al., "Transforming growth factor-β1-mediated renal fibrosis is dependent on the regulation of transforming growth factor receptor 1 expression by let-7b", *Kidney Int.* 2014 February; 85(2):352-61.), IL-13Ra1 (Karo-Atar, D., et al., "A protective role for IL-13 receptor α1 in bleomycin-induced pulmonary injury and repair", *Mucosal Immunology* (2016) 9, 240-253), CCL2 (Affo, S. and Sancho-Bru, P, "CCL2: a link between hepatic inflammation, fibrosis and angiogenesis?", *Gut* 2014. 63(12):1834-5), and TNFAIP3 (Assassi, Shervin and Allanore, Yannick. "Genetic Factors" *Scleroderma: From Pathogenesis to Comprehensive Management.* 2nd Ed. Varga, John et al., "Springer, 2017 25-38. *Google Books*. Web. 15 Aug. 2017.).

Glutaredoxins (GRXs) are redox enzymes that use glutathione as a cofactor. GRXs are oxidized by substrates and reduced non-enzymatically by glutathione (GSH). Namely, GRXs perform de-glutathionylation. Several studies suggest the potential significance of GRXs in treating inflammatory diseases. The expression of GRX1 in alveolar MPs was decreased in human lung specimens with sarcoidosis and allergic alveolitis, and GRX1 was dowaregulated by TGF-β in the A549 human alveolar basal epithelial cell line (Peltoniemi, M., et al., "Expression of glutaredoxin is highly cell specific in human lung and is decreased by transforming growth factor-β in vitro and in interstitial lung diseases in vivo"., *Hum Pathol.* 2004 August; 35(8):1000-7). TGF-β-induced reduction of GRX1 is also confirmed using EpR as mammary epithelial cells (Lee, E. K., et al., "Decreased expression of glutaredoxin 1 is required for transforming growth factor-β1-mediated epithelial-mesenchymal transition of EpRas mammary epithelial cells", *Biochem Biophys Res Commun,* 2010. 391(1): p. 1021-7). In IPF, apoptosis of lung epithelial cell promotes fibroblast activation and remodeling. Caspase-dependent degradation of GRX enhances S-glutathionylation of Fas and subsequent Fas aggregation in lipid rafts, which leads to Fas ligand (FasL)-mediated apoptosis, and this is prevented by overexpression of GRX1 (Anathy, V., et al., "Redox amplification of apoptosis by caspase-dependent cleavage of glutaredoxin 1 and S-glutathionylation of Fas", *J Cell Biol,* 2009. 184(2): p. 241-52; McMillan, D. H., et al., "Attenuation of lung fibrosis in mice with a clinically relevant inhibitor of glutathione-S-transferase pi", *JCI Insight,* 2016. 1(8)). In cystic fibrosis, which is caused by dysfunction of the cystic fibrosis transmembrane conductance regulator (CFTR), CFTR activity was inhibited by S-glutathionylation, and the function was restored by GRX-mediated de-S-glutathionylation (Wang, W., et al. "Reversible silencing of CFTR chloride channels by glutathionylation", *J Gen Physiol,* 2005 February; 125(2):127-41. Epub 2005 Jan. 18). In COPD, the decreased expression of GRX in alveolar MPs was correlated to COPD severity and to reduced lung function (Peltoniemi, M. J., et al., "Modulation of glutaredoxin in the lung and sputum of cigarette smokers and chronic obstructive pulmonary disease", *Respir Res.* 2006 Oct. 25; 7:133).

Glutathione S-transferase Pi (GSTP) is an enzyme that catalyzes protein S-glutathionylation under conditions of oxidative stress and is able to attenuate inflammatory responses. For example in studies using the mouse lung alveolar epithelial cell line C10 exposed to lipopolysaccharide (LPS), both si-RNA mediated knockdown of GSTP and the use of an isotype-selective GSTP inhibitor (TLK117) resulted in enhanced transcriptional activity of the transcription factor NF-kappa B and increased production of pro-inflammatory cytokines (Johnes, J. T., et al., "Glutathione S-transferase pi modulates NF-κB activation and pro-inflammatory responses in lung epithelial cells", Redox Bio. 2016 August; 8:375-82.). Other than GRXs, and GSTP many other molecules are also capable of or have the potential to attenuate or alter fibrotic or alternatively activated inflammatory states. Such molecules include, but are not limited to, TGF-β inhibitors such as tresolimumab, and IL-6 inhibitors such as toclizumab, as indicated by successful clinical trial results with SSc patients (Khanna, D., et al., "Safety and efficacy of subcutaneous tocilizumab in adults with systemic sclerosis (faSScinate): a phase 2, randomised, controlled trial", *Lancet,* 2016. 387(10038): p. 2630-40; Rice, L. M., et al, "Fresolimumab treatment decreases biomarkers and improves clinical symptoms in systemic sclerosis patients", *J Clin Invest,* 2015. 125(7): p. 2795-807).

Chimeric antigen receptor (CAR) cell therapy represents an emerging type of immunotherapy, in which patients are administered with cells, often patients' own lymphocytes, such as T cells, genetically modified to express a CAR that recognizes a specific target molecule. Upon target recognition, the CAR-expressing cells are activated via signaling domains, converting the cells into potent killer cells. The success of this approach is most recognized in cancer (Kalos, M. et al. "T cells with chimeric antigen receptors have potent antitumor effects and can establish memory in patients with advanced leukemia", *Sci Transl Med* 3, 95ra73, doi:10.1126/scitranslmed.3002842 (2011); Porter, D. L., et al., "Chimeric antigen receptor-modified T cells in chronic lymphoid leukemia", *N Engl J Med* 365, 725-733, doi: 10.1056/NEJMoa1103849 (2011)).

SUMMARY OF THE INVENTION

The present invention relates to chimeric antigen receptors (CARs) targeting a molecule which is expressed on disease-associated macrophages (DAMs) or which is over- or aberrantly-expressed in fibrosis, nucleic acid sequences encoding such a CAR, vectors comprising such a nucleic acid sequence, cells comprising such a CAR, treatment methods using such a CAR-expressing cell, methods of using such a CAR-expressing cell, and methods of generating such a CAR-expressing cell.

In one embodiment, the invention provides a CAR comprising an antigen-binding (AB) domain that binds to a target molecule expressed in a fibrotic setting or which is expressed on disease-associated macrophages (DAMs) or which is over- or aberrantly-expressed in fibrosis, a transmembrane (TM) domain, and an intracellular signaling (ICS) domain.

In some embodiments, the CAR further comprises a hinge that joins the AB domain and the TM domain.

In some embodiments, the CAR further comprises one or more costimulatory (CS) domain.

In some embodiments, the target molecule is selected from the group consisting of fibroblast growth factor-inducible 14 (Fn14), CD163, CD206, CD209, FIZZ2 CD11b, SR1, F4/80, LY6G, LY6C, CD68, CD115, MAC2, MARCO, CCL2, TNFAIP3, CD11c, CD16, CD14, CD64, CD32, CD36, CD169, CD204, IL-4R $\alpha$, IL-13RA1, EDNRA, EDNRB, IL6R, PDGFRB, HMGCR, PDGFRA, KDR, FLT1, HLA-DQB1, FGFR3, FGFR1, FLT4, FGFR2, FGFR4, TGFBRI, TGFBRII, PTGIR, CD19, CD109, VDR, IL6, EPHA2, or FGR.

In some embodiments, the target molecule is selected from the group consisting of Fn14, CD163, and CD2 In some embodiments, the target molecule is FnIn some embodiments, the target molecule is CD1 In some embodiments, the target molecule is CD206.

In some embodiments, the AB domain of the CAR comprises an antibody (Ab) or an antigen-binding fragment thereof that binds to the target molecule.

In some embodiments, the Ab or antigen-binding fragment thereof may be selected from a group consisting of a monoclonal Ab, a monospecific Ab, a polyspecific Ab, a humanized Ab, a tetrameric Ab, a tetravalent Ab, a multispecific Ab, a single chain Ab, a domain-specific Ab, a single-domain Ab (dAb), a domain-deleted Ab, an scFc fusion protein, a chimeric Ab, a synthetic Ab, a recombinant Ab, a hybrid Ab, a mutated Ab, CDR-grafted Ab, a fragment antigen-binding (Fab), an F(ab')2, an Fab' fragment, a variable fragment (Fv), a single-chain Fv (scFv) fragment, an Fd fragment, a dAb fragment, a diabody, a nanobody, a bivalent nanobody, a shark variable IgNAR domain, a $V_{HH}$ Ab, a camelid Ab, and a minibody. In some embodiments, the Ab or antigen-binding fragment thereof is an scFv. In some embodiments, the Ab or antigen-binding fragment thereof is a nanobody. In some embodiments, one or more domains of the CAR comprise the ligand TWEAK or an Fn14-binding portion thereof.

In a preferred embodiment, the AB domain of the CAR comprises a nanobody having an amino acid sequence at least 80%, at least 85%, at least 90%, at least 95%, at least 98% at least 99%, or 100% identical to the amino acid sequence of NbMMRm22.84 (SEQ ID NO: 110), to the amino acid sequence encoded by SEQ ID NO: 210, to the amino acid sequence of NbMMRm5.38 (SEQ ID NO: 114), or to the amino acid sequence encoded by SEQ ID NO: 214.

In some embodiments, the AB domain competes for binding to CD206 with a nanobody having an amino acid sequence at least 80%, at least 85%, at least 90%, at least 95%, at least 98% at least 99%, or 100% identical to the amino acid sequence of NbMMRm22.84 (SEQ ID NO: 110), to the amino acid sequence encoded by SEQ ID NO: 210, to the amino acid sequence of NbMMRm5.38 (SEQ ID NO: 114), or to the amino acid sequence encoded by SEQ ID NO: 214.

In some embodiments, the AB domain comprises an Ab or antigen-binding fragment thereof comprising the amino acid sequences of (i) the three CDRs of the nanobody NbMMRm22.84 (SEQ ID NOS: 111-113), or (ii) the three CDRs of the nanobody NbMMRm5.38 (SEQ ID NOS: 115-117). In some embodiments, the AB domain comprises an Ab or antigen-binding fragment thereof comprising amino acid sequences at least 80%, at least 85%, at least 90%, at least 95%, at least 98% at least 99%, or 100% identical to these CDR sequences.

In a preferred embodiment, the AB domain of the CAR comprises a variable heavy ($V_H$) chain having an amino acid sequence at least 80%, at least 85%, at least 90%, at least 95%, at least 98% at least 99%, or 100% identical to the amino acid sequence of the VH chain of AbP4A8 or AbP3G5 (SEQ ID NO: 118 or 126, respectively), or to the amino acid sequence encoded by SEQ ID NO: 218 or 226; and a variable light ($V_L$) chain having an amino acid sequence at least 80%, at least 85%, at least 90%, at least 95%, at least 98% at least 99%, or 100% identical to the amino acid sequence of the $V_L$ chain of AbP4A8 or AbP3G5 (SEQ ID NO: 122 or 130, respectively), or to the amino acid sequence encoded by SEQ ID NO: 222 or 230.

In one aspect, the $V_H$ chain of the AB domain is positioned at the N-terminus of the CAR or closer to the N-terminus of the CAR relative to the $V_L$ chain.

In another aspect, the $V_L$ chain of the AB domain is positioned at the N-terminus of the CAR or closer to the N-terminus of the CAR relative to the $V_H$ chain.

In some embodiments, the FDMM may be selected based on searches conducted using the Open Targets Platform. Genes associated with a specific disease of interest may be searched by typing the disease name at targetvalidation.org. The search will provide a list of molecules that can be altered, at the protein, RNA, DNA, or any other levels, using any possible method, for the treatment of the disease.

According to the website (see targetvalidation.org), calculation of the association score is explained as follows: "We calculate a score for each evidence from the different data sources (e.g. GWAS catalog, EVA) to summarize the strength of the evidence. The score will depend on factors that affect the relative strength of an evidence, for example p values and sample size for the GWAS data. Once we have the scores for each evidence, we calculate an overall score by taking into account the sum of the harmonic progression of each score and adjusting the contribution of each of them using a heuristic weighting." The association score is described in the range of 0 to 1, 1 being the score indicating the strongest disease association.

For example, in case of SSc, Table 2 shows the top 69 genes associated with SSc, whose association score is 0.1 or above, according to the Open Targets Platform. The 69 genes or the gene products represent good therapeutic targets for SSc. The entire gene list (873 target genes in total for SSc) can be found at targetvalidation.org.

In some embodiments, the AB domain of the CAR comprises the portion within TWEAK that binds to FnIn some aspects, the TWEAK is human TWEAK. In some aspects, the TWEAK is mouse TWEAK.

In some embodiments, the AB domain and/or TM domain comprises TWEAK or the AB or TM portion thereof, optionally comprising an amino acid sequence at least 80%, at least 85%, at least 90%, at least 95%, at least 98% at least 99%, or 100% identical (i) to the amino acid sequence of human TWEAK or mouse TWEAK (SEQ ID NO: 134, or 135, respectively), or to the AB or TM portion thereof, or (ii) to the amino acid sequence encoded by SEQ ID NO: 234, or 235.

In some embodiments, the TM domain of the CAR is derived from the TM region, or a membrane-spanning portion thereof, of a protein selected from the group consisting of CD28, CD3ε, CD4, CD5, CD8, CD9, CD16, CD22, CD33, CD37, CD45, CD64, CD80, CD86, CD134, CD137, CD154, TCRα, TCRβ, and CD3ζ.

In a preferred embodiment, the TM domain of the CAR is derived from the TM region of CD28, or a membrane-spanning portion thereof. In some embodiments, the TM domain comprises an amino acid sequence at least 80%, at least 85%, at least 90%, at least 95%, at least 98% at least 99%, or 100% identical to the amino acid sequence of human CD28 TM domain (SEQ ID NO: 146) or mouse CD28 TM domain (SEQ ID NO: 746), or to the amino acid sequence encoded by SEQ ID NO: 246 or SEQ ID NO: 846.

In some embodiments, the ICS domain of the CAR is derived from the ICS domain of CD3ζ, a lymphocyte receptor chain, a TCR/CD3 complex protein, an Fc receptor (FcR) subunit, and an IL-2 receptor subunit, FcR γ, FcR β, CD3 γ, CD3 δ, CD3 ε, CD5, CD22, CD66d, CD79a, CD79b, CD278 (ICOS), FcεRI, DAP10, or DAP12.

In a preferred embodiment, the ICS domain is derived from a cytoplasmic signaling sequence of CD3ζ, or a functional fragment thereof. In some embodiments, the ICS domain comprises an amino acid sequence at least 80%, at least 85%, at least 90%, at least 95%, at least 98% at least 99%, or 100% identical to the amino acid sequence of human CD3 ζ ICS domain (SEQ ID NO: 147) or mouse CD3 zeta ICS domain (SEQ ID NO: 747), or a functional fragment of either domain, or to the amino acid sequence encoded by SEQ ID NO: 247 or SEQ ID NO: 847.

In some embodiments, the CAR comprises a hinge that joins the AB domain and the TM domain; In some embodiments, the hinge may be derived from a hinge of CD28, optionally comprising an amino sequence at least 80%, at least 85%, at least 90%, at least 95%, at least 98% at least 99%, or 100% identical to the amino acid sequence of human CD28 hinge (SEQ ID NO: 145) or mouse CD28 hinge (SEQ ID NO: 745), or to the amino acid sequence encoded by SEQ ID NO: 245 or SEQ ID NO: 845.

In some embodiments, at least one of the one or more CS domains is derived from a cytoplasmic signaling sequence, or functional fragment thereof, of a protein selected from the group consisting of CD28, DAP10, 4-1BB (CD137), CD2, CD4, CD5, CD7, CD8 α, CD8 β, CD11a, CD11b, CD11c, CD11d, CD18, CD19, CD27, CD29, CD30, CD40, CD49d, CD49f, CD69, CD84, CD96 (Tactile), CD100 (SEMA4D), CD103, OX40 (CD134), SLAM (SLAMF1, CD150, IPO-3), CD160 (BY55), SELPLG (CD162), DNAM1 (CD226), Ly9 (CD229), SLAMF4 (CD244, 2B4), ICOS (CD278), B7-H3, BAFFR, BTLA, BLAME (SLAMF8), CEACAM1, CDS, CRTAM, GADS, GITR, HVEM (LIGHTER), IA4, ICAM-1, IL2R β, IL2R γ, IL7R α, ITGA4, ITGA6, ITGAD, ITGAE, ITGAL, ITGAM, ITGAX, ITGB1, ITGB2, ITGB7, KIRDS2, LAT, LFA-1, LIGHT, LTBR, NKG2C, NKG2D, NKp30, NKp44, NKp46, NKp80 (KLRF1), PAG/Cbp, PD-1, PSGL1, SLAMF6 (NTB-A, Ly108), SLAMF7, SLP-76, TNFR2, TRANCE/RANKL, VLA1, VLA-6, or CD83 ligand.

In a preferred embodiment, the CS domain is derived from a cytoplasmic signaling sequence of CD28, 4-1BB, or DAP10, or functional fragment thereof. In some embodiments, the CS domain comprises an amino sequence at least 80%, at least 85%, at least 90%, at least 95%, at least 98% at least 99%, or 100% identical to the amino acid sequence of human CD28 CS domain, human 4-1BB domain, human DAP10 domain, or mouse CD28 CS domain (SEQ ID NO: 156, 157, 158, or 756 respectively), or to the amino acid sequence encoded by SEQ ID NO: 256, 257, 258, or 856.

In some embodiments, (a) the AB domain comprises the amino acid sequence of NbMMRm22.84, NbMMRm5.38, scFvP4A8VHVL, scFvP4A8VLVH, scFvP3G5VHVL, or scFvP3G5VLVH (SEQ ID NOS: 110, 114, 141, 142, 143, or 144, respectively), or the antigen-binding portion of TWEAK, (b) the TM domain is derived from the TM region of CD28 or the TM region of TWEAK, optionally comprising the amino acid sequence at least 80%, at least 85%, at least 90%, at least 95%, at least 98% at least 99%, or 100% identical to the amino acid sequence of human CD28 TM domain (SEQ ID NO: 146) or of mouse CD28TM domain (SEQ ID NO: 746), or a membrane-spanning portion of any of the foregoing TM domains, and (c) the ICS domain is derived from a cytoplasmic signaling sequence of CD3ζ, optionally comprising the amino acid sequence at least 80%, at least 85%, at least 90%, at least 95%, at least 98% at least 99%, or 100% identical to the amino acid sequence of human CD3 ζ ICS domain (SEQ ID NO: 147) or of mouse CD3 ζ ICS domain (SEQ ID NO: 747) or a functional fragment of any of the foregoing ICS domains.

In yet another preferred embodiment, the CAR comprises an amino acid sequence at least 80%, at least 85%, at least 90%, at least 95%, at least 98% at least 99%, or 100% identical to the amino acid sequence of NbMMRm22.84-CD28H-CD28TM-CD28CS-CD3zICS (SEQ ID NO: 160), NbMMRm5.38-CD28H-CD28TM-CD28CS-CD3zICS (SEQ ID NO: 161), scFvP4A8$V_HV_L$-CD28H-CD28TM-CD28CS-CD3zICS (SEQ ID NO: 162), scFvP4A8$V_LV_H$-CD28H-CD28TM-CD28CS-CD3zICS (SEQ ID NO: 163), scFP3G5$V_HV_L$-CD28H-CD28TM-CD28CS-CD3zICS (SEQ ID NO: 164), scFvP3G5$V_LV_H$-CD28H-CD28TM-CD28CS-CD3zICS (SEQ ID NO: 165), CD3zICS-CD28CS-TWEAK (SEQ ID NO; 136), NbMMRm22.84-

CD28H-CD28TM-41BBCS-CD3zICS (SEQ ID NO: 166), NbMMRm5.38-CD28H-CD28TM-41BBCS-CD3zICS (SEQ ID NO: 167), scFvP4A8$V_HV_L$-CD28H-CD28TM-41BBCS-CD3zICS (SEQ ID NO: 168), scFvP4A8$V_LV_H$-CD28H-CD28TM-41BBCS-CD3zICS (SEQ ID NO: 169), scFvP3G5 $V_HV_L$-CD28H-CD28TM-41BBCS-CD3zICS (SEQ ID NO: 170), scFvP3G5 $V_LV_H$-CD28H-CD28TM-41BBCS-CD3zICS (SEQ ID NO: 171), CD3zICS-41BBCS-TWEAK (SEQ ID NO: 137), NbMMRm22.84-CD28H-CD28TM-DAP10CS-CD3zICS (SEQ ID NO: 172), NbMMRm5.38-CD28H-CD28TM-DAP10CS-CD3zICS (SEQ ID NO: 173), scFvP4A8$V_HV_L$-CD28H-CD28TM-DAP10CS-CD3zICS (SEQ ID NO: 174), scFvP4A8$V_LV_H$-CD28H-CD28TM-DAP10CS-CD3ICS (SEQ ID NO: 175), scFvP3G5 $V_HV_L$-CD28H-CD28TM-DAP10CS-CD3zICS (SEQ ID NO: 176), scFvP3G5$V_LV_H$-CD28H-CD28TM-DAP10CS-CD3zICS (SEQ ID NO: 177), CD3zICS-DAP10CS-TWEAK (SEQ ID NO: 138), NbMMRm22.84-mCD28H-mCD28TM-mCD28CS-mCD3zICS (SEQ ID NO: 760), NbMMRm5.38-mCD28H-mCD28TM-mCD28CS-mCD3zICS (SEQ ID NO: 761), scFvP4A8$V_HV_L$-mCD28H-mCD28TM-mCD28CS-mCD3zICS (SEQ ID NO: 762), scFvP4A8$V_LV_H$-mCD28H-mCD28TM-mCD28CS-mCD3zICS (SEQ ID NO: 763), scFvP3G5 $V_HV_L$-mCD28H-mCD28TM-mCD28CS-mCD3zICS (SEQ ID NO: 764), scFvP3G5$V_LV_H$-mCD28H-mCD28TM-mCD28CS-mCD3zICS (SEQ ID NO: 765), mCD3zICS-mCD28CS-mTWEAK (SEQ ID NO: 766), or to the amino acid sequence encoded by SEQ ID NO: 260, 261, 262, 263, 264, 265, 236, 266, 267, 268, 269, 270, 271, 237, 272, 273, 274, 275, 276, 277, 238, or 860, 861, 862, 863, 864, 865, or 866.

In some embodiments, the CAR further comprises a cytotoxic agent conjugated to the AB domain.

In one aspect, the invention provides an isolated nucleic acid sequence encoding a CAR wherein the CAR comprises an AB domain that binds to a target molecule which is expressed on DAMs or which is over- or aberrantly-expressed in fibrosis, a TM domain, and an ICS domain. In some embodiments, the CAR encoded by the nucleic acid further comprises a hinge that joins the AB domain and the TM domain. In some embodiments, the CAR encoded by the nucleic acid further comprises one or more CS domains.

The isolated nucleic acid sequence may encode a CAR having any of the features described above. In particular embodiments, the nucleic acid may encode a CAR having the features as follows.

In some embodiments, the target molecule of the CAR encoded by the nucleic acid sequence is selected from the group consisting of fibroblast growth factor-inducible 14 (Fn14), CD163, CD206, CD209, FIZZ2 CD11b, SR1, F4/80, LY6G, LY6C, CD68, CD115, MAC2, MARCO, CCL2, TNFAIP3, CD11c, CD16, CD14, CD64, CD32, CD36, CD169, CD204, IL-4R $\alpha$, IL-13RA1, EDNRA, EDNRB, IL6R, PDGFRB, HMGCR, PDGFRA, KDR, FLT1, HLA-DQB1, FGFR3, FGFR1, FLT4, FGFR2, FGFR4, TGFBRI, TGFBRII, PTGIR, CD19, CD109, VDR, IL6, EPHA2, or FGR.

In some embodiments, the target molecule is selected from the group consisting of Fn14, CD163, and CD206.

In some embodiments, the target molecule is Fn14.

In some embodiments, the target molecule is CD163.

In some embodiments, the target molecule is CD206.

In some embodiments, the AB domain of the CAR encoded by the nucleic acid sequence comprises an Ab or an antigen-binding fragment thereof that binds to the target molecule.

In some embodiments, the Ab or antigen-binding fragment thereof is selected from a group consisting of a monoclonal Ab, a monospecific Ab, a polyspecific Ab, a humanized Ab, a tetrameric Ab, a tetravalent Ab, a multispecific Ab, a single chain Ab, a domain-specific Ab, a single domain Ab, a domain-deleted Ab, an scFc fusion protein, a chimeric Ab, a synthetic Ab, a recombinant Ab, a hybrid Ab, a mutated Ab, CDR-grafted Ab, an Fab, an F(ab')2, an Fab' fragment, an Fv fragment, a single-chain Fv (scFv) fragment, an Fd fragment, a dAb fragment, a diabody, a nanobody, a bivalent nanobody, a shark variable IgNAR domain, a VHH Ab, a camelid Ab, and a minibody.

In some embodiments, the Ab or antigen-binding fragment thereof is an scFv.

In some embodiments, the Ab or antigen-binding fragment thereof is a nanobody.

In some embodiments, one or more domains of the CAR encoded by the nucleic acid sequence comprise the ligand TWEAK or an Fn14-binding portion thereof.

In some embodiments, the AB domain of the CAR encoded by the nucleic acid sequence comprises a nanobody having an amino acid sequence at least 80%, at least 85%, at least 90%, at least 95%, at least 98% at least 99%, or 100% identical (i) to the amino acid sequence of NbMMRm22.84 (SEQ ID NO: 110), (ii) to the amino acid sequence encoded by SEQ ID NO: 210, (iii) to the amino acid sequence of NbMMRm5.38 (SEQ ID NO: 114), or (iv) to the amino acid sequence encoded by SEQ ID NO: 214.

In some embodiments, the AB domain of the CAR encoded by the nucleic acid sequence competes for binding to CD206 with a nanobody having an amino acid sequence at least 80%, at least 85%, at least 90%, at least 95%, at least 98% at least 99%, or 100% identical (i) to the amino acid sequence of NbMMRm22.84 (SEQ ID NO: 110), (ii) to the amino acid sequence encoded by SEQ ID NO: 210, (iii) to the amino acid sequence of NbMMRm5.38 (SEQ ID NO: 114), or (iv) to the amino acid sequence encoded by SEQ ID NO: 214.

In some embodiments, the AB domain of the CAR encoded by the nucleic acid sequence comprises an Ab or antigen-binding fragment thereof comprising the amino acid sequences of (i) the three CDRs of the nanobody NbMMRm22.84 (SEQ ID NOS: 111-113), or (ii) the three CDRs of the nanobody NbMMRm5.38 (SEQ ID NOS: 115-117).

In some embodiments, the AB domain of the CAR encoded by the nucleic acid sequence comprises an Ab or antigen-binding fragment thereof comprising amino acid sequences at least 80%, at least 85%, at least 90%, at least 95%, at least 98% at least 99%, or 100% identical to these CDR sequences.

In some embodiments, the AB domain of the CAR encoded by the nucleic acid sequence comprises (a) a VH chain having an amino acid sequence at least 80%, at least 85%, at least 90%, at least 95%, at least 98% at least 99%, or 100% identical (i) to the amino acid sequence of the VH chain of AbP4A8 or AbP3G5 (SEQ ID NOS: 118 or 126, respectively), or (ii) to the amino acid sequence encoded by SEQ ID NO: 218 or 226; (b) a VL chain having an amino acid sequence at least 80%, at least 85%, at least 90%, at least 95%, at least 98% at least 99%, or 100% identical (i) to the amino acid sequence of the VL chain of AbP4A8 or AbP305 (SEQ ID NOS: 122 or 130, respectively), or (ii) to the amino acid sequence encoded by SEQ ID NO: 222 or 230; and (c) optionally a linker that links the VH chain to the VL chain, wherein the linker optionally comprises an amino acid sequence at least 80%, at least 85%, at least 90%, at least 95%, at least 98% at least 99%, or 100% identical (i) to SEQ ID NO: 140, or (ii) to the amino acid sequence encoded by SEQ ID NO: 240.

In some embodiments, the AB domain of the CAR encoded by the nucleic acid sequence comprises an scFv fragment comprising an amino acid sequence at least 80%, at least 85%, at least 90%, at least 95%, at least 98% at least 99%, or 100% identical (i) to the amino acid sequence of scFvP4A8VHVL, scFvP4A8VLVH, scFvP3G5VHVL, or scFvP3G5VLVH (SEQ ID NOS: 141, 142, 143, or 144, respectively), or (ii) to the amino acid sequence encoded by SEQ ID NOS: 241, 242, 243, or 244.

In some embodiments, the AB domain of the CAR encoded by the nucleic acid sequence competes for binding to Fn14 with an scFv fragment comprising an amino acid sequence at least 80%, at least 85%, at least 90%, at least 95%, at least 98% at least 99%, or 100% identical (i) to the amino acid sequence of scFvP4A8VHVL, scFvP4A8VLVH, scFvP3G5VHVL, or scFvP3G5VLVH (SEQ ID NOS: 141, 142, 143, or 144, respectively), or (ii) to the amino acid sequence encoded by SEQ ID NOS: 241, 242, 243, or 244.

In some embodiments, the AB domain of the CAR encoded by the nucleic acid sequence comprises an Ab or antigen-binding fragment thereof comprising an amino acid sequence at least 80%, at least 85%, at least 90%, at least 95%, at least 98% at least 99%, or 100% identical to the amino acid sequences of (i) the three heavy chain CDRs (SEQ 1D NOS: 119-121) and the three light chain CDRs (SEQ ID NOS: 123-125) of AbP4A8, or (i) the three heavy chain CDRs (SEQ ID NOS: 127-129) and the three light chain CDRs (SEQ ID NOS: 131-133) of AbP3G5.

In some embodiments, the AB domain of the CAR encoded by the nucleic acid sequence comprises an Ab or antigen-binding fragment thereof comprising amino acid sequences at least 80%, at least 85%, at least 90%, at least 95%, at least 98% at least 99%, or 100% identical to these CDR sequences.

In some embodiments, the AB domain and/or TM domain of the CAR encoded by the nucleic acid sequence comprises TWEAK or the AB or TM portion thereof, optionally comprising an amino acid sequence at least 80%, at least 85%, at least 90%, at least 95%, at least 98% at least 99%, or 100% identical (i) to the amino acid sequence of human TWEAK or mouse TWEAK (SEQ ID NO: 134 or 135, respectively), or to the AB or TM portion thereof, or (ii) to the amino acid sequence encoded by SEQ ID NO: 234, or 235.

In some embodiments, the TM domain of the CAR encoded by the nucleic acid sequence is derived from a TM region, or a membrane-spanning portion thereof, of a protein selected from the group consisting of CD28, CD3 ε, CD4, CD5, CD8, CD9, CD16, CD22, CD33, CD37, CD45, CD64, CD80, CD86, CD134, CD137, CD154, TCR α, TCR β, and CD3 ζ.

In some embodiments, the TM domain of the CAR encoded by the nucleic acid sequence is derived from the TM region of CD28, or a membrane-spanning portion thereof, optionally comprising an amino acid sequence at least 80%, at least 85%, at least 90%, at least 95%, at least 98% at least 99%, or 100% identical (i) to the amino acid sequence of human CD28 TM domain (SEQ ID NO: 146) or mouse CD28 TM domain (SEQ ID NO: 746), or a membrane-spanning portion of either domain, or (ii) to the amino acid sequence encoded by SEQ ID NO: 246 or SEQ ID NO: 846.

In some embodiments, the ICS domain of the CAR encoded by the nucleic acid sequence is derived from a cytoplasmic signaling sequence, or a functional fragment thereof, of a protein selected from the group consisting of CD3 ζ, a lymphocyte receptor chain, a TCR/CD3 complex protein, an Fc receptor (FcR) subunit, an IL-2 receptor subunit, FcR γ, FcR β, CD3 γ, CD3 δ, CD3 ε, CD5, CD22, CD66d, CD79a, CD79b, CD278 (ICOS), DAP10, and DAP12.

In some embodiments, the ICS domain is derived from a cytoplasmic signaling sequence of CD3ζ, or a functional fragment thereof, the ICS domain optionally comprising an amino acid sequence at least 80%, at least 85%, at least 90%, at least 95%, at least 98% at least 99%, or 100% identical (i) to the amino acid sequence of human CD3 ζ ICS domain (SEQ ID NO: 147) or mouse CD3 ζ ICS domain (SEQ ID NO: 747), or a functional fragment of either domain, or (ii) to the amino acid sequence encoded by SEQ ID NO: 247 or SEQ ID NO: 847.

In some embodiments, the hinge of the CAR encoded by the nucleic acid sequence is derived from CD28, the hinge optionally comprising an amino sequence at least 80%, at least 85%, at least 90%, at least 95%, at least 98% at least 99%, or 100% identical (i) to the amino acid sequence of human CD28 hinge (SEQ ID NO: 145) or mouse CD28 hinge (SEQ ID NO: 745), or (ii) to the amino acid sequence encoded by SEQ ID NO: 245 or SEQ ID NO: 845.

In some embodiments, at least one of the one or more CS domains of the CAR encoded by the nucleic acid sequence is derived from a cytoplasmic signaling sequence, or functional fragment thereof, of a protein selected from the group consisting of CD28, DAP10, 4-1BB (CD137), CD2, CD4, CDS, CD7, CD8 α, CD8 β, CD11a, CD11b, CD11c, CD11d, CD18, CD19, CD27, CD29, CD30, CD40, CD49d, CD49f, CD69, CD84, CD96 (Tactile), CD100 (SEMA4D), CD103, OX40 (CD134), SLAM (SLAMF1, CD150, IPO-3), CD160 (BY55), SELPLG (CD162), DNAM1 (CD226), Ly9 (CD229), SLAMF4 (CD244, 2B4), ICOS (CD278), B7-H3, BAFFR, BTLA, BLAME (SLAMF8), CEACAM1, CDS, CRTAM, GADS, GITR, HVEM (LIGHTER), IA4, ICAM-1, IL2R β, IL2Rγ, IL7R α, ITGA4, ITGA6, ITGAD, ITGAE, ITGAL, ITGAM, ITGAX, ITGB1, ITGB2, ITGB7, KIRDS2, LAT, LFA-1, LIGHT, LTBR, NKG2C, NKG2D, NKp30, NKp44, NKp46, NKp80 (KLRF1), PAG/Cbp, PD-1, PSGL1, SLAMF6 (NTB-A, Ly108), SLAMF7, SLP-76, TNFR2, TRANCE/RANKL, VLA1, VLA-6, and CD83 ligand.

In some embodiments, the CS domain of the CAR encoded by the nucleic acid sequence is derived from a cytoplasmic signaling sequence of CD28, 4-1BB, or DAP10, or functional fragment thereof, the CS domain optionally comprising an amino sequence at least 80%, at least 85%, at least 90%, at least 95%, at least 98% at least 99%, or 100% identical (i) to the amino acid sequence of human CD28 CS domain, human 4-1BB CS domain, human DAP10 CS domain, or mouse CD28 CS domain (SEQ ID NO: 156, 157, 158, or 756, respectively), or (ii) to the amino acid sequence encoded by SEQ ID NO: 256, 257, 258, or 856.

In some embodiments, (a) the AB domain comprises the amino acid sequence of NbMMRm22.84, NbMMRm5.38, scFvP4A8VHVL, scFvP4A8VLVH, scFvP3G5VHVL, or scFvP3G5VLVH (SEQ ID NOS: 110, 114, 141, 142, 143, or 144, respectively), or the AB portion of TWEAK, (b) the TM domain is derived from the TM region of CD28 or the TM region of TWEAK, optionally comprising the amino acid sequence at least 80%, at least 85%, at least 90%, at least 95%, at least 98% at least 99%, or 100% identical to the amino acid sequence of human CD28 TM domain (SEQ ID NO: 146) or of mouse CD28TM domain (SEQ ID NO: 746), or a membrane-spanning portion of any of the foregoing TM domains, and (c) the ICS domain is derived from a cytoplasmic signaling sequence of CD3 ζ, optionally comprising the amino acid sequence at least 80%, at least 85%, at least 90%, at least 95%, at least 98% at least 99%, or 100% identical to the amino acid sequence of human CD3 ζ ICS domain (SEQ ID NO: 147) or of mouse CD3 ζ ICS domain (SEQ ID NO: 747) or a functional fragment of any of the foregoing ICS domains.

In some embodiments, the CAR encoded by the nucleic acid sequence comprises an amino acid sequence at least 80%, at least 85%, at least 90%, at least 95%, at least 98% at least 99%, or 100% identical to the amino acid sequence of (i) NbMMRm22.84-CD28H-CD28TM-CD28CS-CD3zICS (SEQ ID NO: 160), (ii) NbMMRm5.38-CD28H-CD28TM-CD28CS-CD3zICS (SEQ ID NO: 161), (iii) scFvP4A8VHVL-CD28H-CD28TM-CD28CS-CD3zICS (SEQ ID NO: 162), (iv) scFvP4A8VLVH-CD28H-CD28TM-CD28CS-CD3zICS (SEQ ID NO: 163), (v) scFvP3G5VHVL-CD28H-CD28TM-CD28CS-CD3zICS (SEQ ID NO: 164), (vi) scFvP3G5VLVH-CD28H-CD28TM-CD28CS-CD3zICS (SEQ ID NO: 165), (vii) CD3zICS-CD28CS-TWEAK (SEQ ID NO: 136) (viii) NbMMRm22.84-CD28H-CD28TM-41BBCS-CD3zICS (SEQ ID NO: 166), (ix) NbMMRm5.38-CD28H-CD28TM-41BBCS-CD3zICS (SEQ ID NO: 167), (x) scFvP4A8VHVL-CD28H-CD28TM-41BBCS-CD3zICS (SEQ ID NO: 168), (xi) scFvP4A8VLVH-CD28H-CD28TM-41BBCS-CD3zICS (SEQ ID NO: 169), (xii) scFvP3G5VHVL-CD28H-CD28TM-41BBCS-CD3zICS (SEQ ID NO: 170), (xiii) scFvP3G5VLVH-CD28H-CD28TM-41BBCS-CD3zICS (SEQ ID NO: 171), (xiv) CD3zICS-41BBCS-TWEAK (SEQ ID NO: 137) (xv) NbMMRm22.84-CD28H-CD28TM-DAP10CS-CD3zICS (SEQ ID NO: 172), (xvi) NbMMRm5.38-CD28H-CD28TM-DAP10CS-CD3zICS (SEQ ID NO: 173), (xvii) scFvP4A8VHVL-CD28H-CD28TM-DAP10CS-CD3zICS (SEQ ID NO: 174), (xviii) scFvP4A8VLVH-CD28H-CD28TM-DAP10CS-CD3zICS (SEQ ID NO: 175), (xix) scFvP3G5VHVL-CD28H-CD28TM-DAP10CS-CD3zICS (SEQ ID NO: 176), (xx) scFvP3G5VLVH-CD28H-CD28TM-DAP10CS-CD3zICS (SEQ ID NO: 177), (xxi) CD3zICS-DAP10CS-TWEAK (SEQ ID NO: 138) (xxii) NbMMRm22.84-mCD28H-mCD28TM-mCD28CS-mCD3zICS (SEQ ID NO: 760), (xxiii) NbMMRm5.38-mCD28H-mCD28TM-mCD28CS-mCD3zICS (SEQ ID NO: 761), (xxiv) scFvP4A8VHVL-mCD28H-mCD28TM-mCD28CS-mCD3zICS (SEQ ID NO: 762), (xxv) scFvP4A8VLVH-mCD28H-mCD28TM-mCD28CS-mCD3zICS (SEQ ID NO: 763), (xxvi) scFvP3G5VHVL-mCD28H-mCD28TM-mCD28CS-mCD3zICS (SEQ ID NO: 764), (xxvii) scFvP3G5VLVH-mCD28H-mCD28TM-mCD28CS-mCD3zICS (SEQ ID NO: 765), (xxviii) mCD3zICS-mCD28CS-mTWEAK (SEQ ID NO: 766); or (xxix) to the amino acid sequence encoded by SEQ ID NO: 260, 261, 262, 263, 264, 265, 236, 266, 267, 268, 269, 270, 271, 237, 272, 273, 274, 275, 276, 277, 238, or 860, 861, 862, 863, 864, 865, or 866.

In some embodiments, the CAR encoded by the nucleic acid sequence further encodes a leader sequence, optionally comprising a nucleic acid sequence at least 80%, at least 85%, at least 90%, at least 95%, at least 98% at least 99%, or 100% identical (i) to SEQ ID NO: 205, or (ii) to the nucleic acid sequence encoding the amino acid sequence of SEQ ID NO: 105.

In some embodiments, the nucleic acid sequence further comprises an internal ribosome entry site (IRES) sequence and/or a T2A ribosome skip sequence, wherein the T2A ribosome skip sequence is optionally at least 80%, at least 85%, at least 90%, at least 95%, at least 98% at least 99%, or 100% identical (i) to SEQ ID NO: 250, or (ii) to a nucleic acid sequence encoding the amino acid sequence of SEQ ID NO: 150.

In some embodiments, the nucleic acid sequence further encodes a selectable marker. In some embodiments, the selectable marker is truncated CD19 (trCD19). In some embodiments, the selectable marker comprises an amino acid sequence at least 80%, at least 85%, at least 90%, at least 95%, at least 98% at least 99%, or 100% identical (i) to human trCD19 (SEQ ID NO: 151) or mouse trCD19 (SEQ ID NO: 751), or (ii) to the amino acid sequence encoded by the nucleic acid sequence of SEQ ID NO: 251 or SEQ ID NO: 851.

In some aspects, the invention provides an isolated nucleic acid sequence comprising a sequence at least 85%, at least 90%, at least 95%, at least 98% at least 99%, or 100% identical (i) to the nucleic acid sequence of SEQ ID NO: 278, 279, 280, 281, 282, 283, 296, 284, 285, 286, 287, 288, 289, 297, 290, 291, 292, 293, 294, 295, 298, 878, 879, 880, 881, 882, 883, 884, 678, 679, 680, 681, 682, 683, 236, 684, 685, 686, 687, 688, 689, 237, 690, 691, 692, 693, 694, 695, 238, or 866; or (ii) to the nucleic acid sequence encoding the amino acid sequence of (i) LS-NbMMRm22.84-CD28H-CD28TM-CD28CS-CD3zICS-T2A-trCD19 (SEQ ID NO: 178), (ii) LS-NbMMRm5.38-CD28H-CD28TM-CD28CS-CD3zICS-T2A-trCD19 (SEQ ID NO: 179), (iii) LS-scFvP4A8VHVL-CD28H-CD28TM-CD28CS-CD3zICS-T2A-trCD19 (SEQ ID NO: 180), (iv) LS-scFvP4A8VLVH-CD28H-CD28TM-CD28CS-CD3zICS-T2A-trCD19 (SEQ ID NO: 181), (v) LS-scFvP3G5VHVL-CD28H-CD28TM-CD28CS-CD3zICS-T2A-trCD19 (SEQ ID NO: 182), (vi) LS-scFvP3G5VLVH-CD28H-CD28TM-CD28CS-CD3zICS-T2A-trCD19 (SEQ ID NO: 183), (vii) CD3zICS-CD28CS-TWEAK-T2A-trCD19 (SEQ ID NO: 196) (viii) LS-NbMMRm22.84-CD28H-CD28TM-41BBCS-CD3zICS-T2A-trCD19 (SEQ ID NO: 184), (ix) LS-NbMMRm5.38-CD28H-CD28TM-41BBCS-CD3zICS-T2A-trCD19 (SEQ ID NO: 185), (x) LS-scFvP4A8VHVL-CD28H-CD28TM-41BBCS-CD3zICS-T2A-trCD19 (SEQ ID NO: 186), (xi) LS-scFvP4A8VLVH-CD28H-CD28TM-41BBCS-CD3zICS-T2A-trCD19 (SEQ ID NO: 187), (xii) LS-scFvP3G5VHVL-CD28H-CD28TM-41BBCS-CD3zICS-T2A-trCD19 (SEQ ID NO: 188), (xiii) LS-scFvP3G5VLVH-CD28H-CD28TM-41 BBCS-CD3zICS-T2A-trCD19 (SEQ ID NO: 189), (xiv) CD3zICS-41BBCS-TWEAK-T2A-trCD19 (SEQ ID NO: 197) (xv) LS-NbMMRm22.84-CD28H-CD28TM-DAP10CS-CD3zICS-T2A-trCD19 (SEQ ID NO: 190), (xvi) LS-NbMMRm5.38-CD28H-CD28TM-DAP10CS-CD3zICS-T2A-trCD19 (SEQ ID NO: 191), (xvii) LS-scFvP4A8VHVL-CD28H-CD28TM-DAP10CS-CD3zICS-T2A-trCD19 (SEQ ID NO: 192), (xviii) LS-scFvP4A8VLVH-CD28H-CD28TM-DAP10CS-CD3zICS-T2A-trCD19 (SEQ ID NO: 193), (xix) LS-scFvP3G5VHVL-CD28H-CD28TM-DAP10CS-CD3zICS-T2A-trCD19 (SEQ ID NO: 194), (xx) LS-scFvP3G5VLVH-CD28H-CD28TM-DAP10CS-CD3zICS-T2A-trCD19 (SEQ ID NO: 195), (xxi) CD3zICS-DAP10CS-TWEAK-T2A-trCD19 (SEQ ID NO: 198) (xxii) LS-NbMMRm22.84-mCD28H-mCD28TM-mCD28CS-mCD3zICS-T2A-mtrCD19 (SEQ ID NO: 778), (xxiii)

LS-NbMMRm5.38-mCD28H-mCD28TM-mCD28CS-mCD3zICS-T2A-mtrCD19 (SEQ ID NO: 779), (xxiv) LS-scFvP4A8VHVL-mCD28H-mCD28TM-mCD28CS-mCD3zICS-T2A-mtrCD19 (SEQ ID NO; 780), (xxv) LS-scFvP4A8VLVH-mCD28H-mCD28TM-mCD28CS-mCD3zICS-T2A-mtrCD19 (SEQ ID NO: 781), (xxvi) LS-scFvP3G5VHVL-mCD28H-mCD28TM-mCD28CS-mCD3zICS-T2A-mtrCD19 (SEQ ID NO 782), (xxvii) LS-scFvP3G5VLVH-mCD28H-mCD28TM-mCD28CS-mCD3zICS-T2A-mtrCD19 (SEQ ID NO: 783), (xxviii) mCD3zICS-mCD28CS-mTWEAK-T2A-mtrCD19 (SEQ ID NO: 784) (xxix) LS-NbMMRm22.84-CD28H-CD28TM-CD28CS-CD3zICS (SEQ ID NO: 578), (xxx) LS-NbMMRm5. 38-CD28H-CD28TM-CD28CS-CD3zICS (SEQ ID NO: 579), (xxxi) LS-scFvP4A8VHVL-CD28H-CD28TM-CD28CS-CD3zICS (SEQ ID NO: 580), (xxxii) LS-scFvP4A8VLVH-CD28H-CD28TM-CD28CS-CD3zICS (SEQ ID NO: 581), (xxxiii) LS-scFvP3G5VLVH-CD28H-CD28TM-CD28CS-CD3zICS (SEQ ID NO: 582), (xxxiv) LS-scFvP3G5VLVH-CD28H-CD28TM-CD28CS-CD3zICS (SEQ ID NO: 583), (xxxv) CD3zICS-CD28CS-TWEAK (SEQ ID NO: 136) (xxxvi) LS-NbMMRm22.84-CD28H-CD28TM-41BBCS-CD3zICS (SEQ ID NO: 584), (xxxvii) LS-NbMMRm5.38-CD28H-CD28TM-41BBCS-CD3zICS (SEQ ID NO: 585), (xxxviii) LS-scFvP4A8VHVL-CD28H-CD28TM-41BBCS-CD3zICS (SEQ ID NO: 586), (xxxix) LS-scFvP4A8VLVH-CD28H-CD28TM-41BBCS-CD3zICS (SEQ ID NO: 587), (xxxx) LS-scFvP3G5VHVL-CD28H-CD28TM-41BBCS-CD3zICS (SEQ ID NO: 588), (xxxxi) LS-scFvP3G5VLVH-CD28H-CD28TM-41BBCS-CD3zICS (SEQ ID NO: 589), (xxxxii) CD3zICS-41BBCS-TWEAK (SEQ ID NO: 137) (xxxxiii) LS-NbMMRm22.84-CD284-CD28TM-DAP10CS-CD3zICS (SEQ ID NO: 590), (xxxxiv) LS-NbMMRm5.38-CD28H-CD28TM-DAP10CS-CD3zICS (SEQ ID NO: 591), (xxxxv) LS-scFvP4A8VHVL-CD28H-CD28TM-DAP10CS-CD3zICS (SEQ ID NO: 592), (xxxxvi) LS-scFvP4A8VLVH-CD28H-CD28TM-DAP10CS-CD3zICS (SEQ ID NO: 593), (xxxxvii) LS-scFvP3G5VHVL-CD28H-CD28TM-DAP10CS-CD3zICS (SEQ ID NO: 594), (xxxxviii) LS-scFvP3G5VLVH-CD28H-CD28TM-DAP10CS-CD3zICS (SEQ ID NO: 595), (i) CD3zICS-DAP10CS-TWEAK (SEQ ID NO: 138), or (1) mCD3zICS-mCD28CS-mTWEAK (SEQ ID NO: 766).

In some embodiments, the nucleic acid further comprises a nucleic acid sequence encoding a suicide mechanism.

The invention also provides a vector comprising a nucleic acid sequence according to any of the foregoing embodiments. In some embodiments, the invention provides a vector comprising a nucleic acid sequence encoding a CAR having any of the features described in the foregoing embodiments.

In some embodiments, the vector further encodes a fibrotic disease-modulatory molecule (FDMM).

The invention also provides two or more vectors, at least one comprising a nucleic acid sequence according to any of the foregoing embodiments, and at least one other comprising a gene encoding a FDMM.

In some embodiments, the FDMM is (i) glutaredoxin (GRX), optionally having an amino acid sequence at least 80%, at least 85%, at least 90%, at least 95%, at least 98% at least 99%, or 100% identical to human GRX1, human GRX2, human GRX3, human GRX5, or mouse GRX1 (SEQ ID NOs: 301, 302, 303, 305, or 311, respectively), or to an amino acid sequence encoded by SEQ ID NOs: 401, 402, 403, 405, or 411; (ii) a functional GRX variant, optionally having a mutation in the enzyme's active site, and/or putative caspase cleavage site, and optionally having an amino acid sequence at least 80%, at least 85%, at least 90%, at least 95%, at least 98% at least 99%, or 100% identical to human GRX1 variant 2, or human GRX1 variant 12 (SEQ ID NOs: 322 or 332, respectively), or to an amino acid sequence encoded by SEQ ID NOs: 422, or 432; (iii) glutathione S-transferase pi (GSTP), optionally having an amino acid sequence at least 80%, at least 85%, at least 90%, at least 95%, at least 98% at least 99%, or 100% identical to human GSTP or mouse GSTP (SEQ ID NOs: 341 or 351, respectively), or to an amino acid sequence encoded by SEQ ID NOs: 441 or 451; or (iv) a functional GSTP variant.

In some embodiments, the FDMM is (i) IL-37; (ii) II-12; (iii) TNF-α; (iv) IFN-γ; (v) CCL2; (vi) TNFAIP3; or (vii) a molecule capable of altering the expression level, activation status, or function of a disease-associated protein.

In another preferred embodiment, the FDMM is a functional variant of hGSTP or mGSTP.

In some preferred embodiments, the FDMM is a molecule capable of altering an inflammatory status.

In some aspects, the FDMM is IL-37, IL-12, TNF-α, IFN-γ, or a molecule capable of altering the expression level, activation status, or function of a disease-associated protein. When such a disease is SSc, the disease-associated protein is TGF-β, TGF-β receptor, IL-6, IL-6 receptor, endothelin receptor type A (EDNRA), endothelin receptor type B (EDNRB), platelet derived growth factor receptor β (PDGFRB), 3-hydroxy-3-methylglutaryl-CoA reductase (HMGCR), phosphodiesterase 5A (PDE5A), signal transducer and activator of transcription 4 (STAT4), platelet derived growth factor receptor α (PDGFRA), kinase insert domain receptor (KDR), fins related tyrosine kinase 1 (FLT1), major histocompatibility complex, class 11, DQ β1 (HLA-DQB1), fibroblast growth factor receptor 3 (FGFR3), fibroblast growth factor receptor 1 (FGFR1), fins related tyrosine kinase 4 (FLT4), fibroblast growth factor receptor 2 (FGFR2), fibroblast growth factor receptor 4 (FGFR4), interferon regulatory factor 8 (IRF8), CD247, TNFAIP3 interacting protein 1 (TNIP1), integrin subunit α M (ITGAM), SRY-box 5 (SOX5), zinc finger CCCH-type containing 10 (ZC3H10), TNF α induced protein 3 (TNFAIP3), BLK proto-oncogene, Src family tyrosine kinase (BLK), ankyrin repeat and sterile a motif domain containing 1A (ANKS1A), prostaglandin I2 (prostacyclin) receptor (IP) (PTGIR), KIT proto-oncogene receptor tyrosine kinase (KIT), ABL proto-oncogene 1, non-receptor tyrosine kinase (ABL1), growth factor receptor bound protein 10 (GRB10), chromosome 15 open reading frame 39 (C15orf39), TNF superfamily member 4 (TNFSF4), laminin subunit γ 2 (LAMC2), IKAROS family zinc finger 3 (IKZF3), IL-13, IL-13 receptor, TNF superfamily member 13b (TNFSF13B), membrane spanning 4-domains A1 (MS4A1), sodium voltage-gated channel α subunit 4 (SCN4A), sodium voltage-gated channel α subunit 2 (SCN2A), sodium voltage-gated channel α subunit 8 (SCN8A), sodium voltage-gated channel α subunit 11 (SCN11A), sodium voltage-gated channel α subunit 7 (SCN7A), sodium voltage-gated channel α subunit 3 (SCN3A), sodium voltage-gated channel α subunit 10 (SCN10A), sodium voltage-gated channel α subunit 5 (SCN5A), sodium voltage-gated channel α subunit 9 (SCN9A), sodium voltage-gated channel α subunit 1 (SCN1A), ras homolog family member B (RHOB), FK506 binding protein 1A (FKBP1A), SRC proto-oncogene, non-receptor tyrosine kinase (SRC), CD19, connective tissue growth factor (CTGF), CD109, vitamin D (1,25-dihydroxyvitamin D3) receptor (VDR), dickkopf WNT signaling pathway inhibitor 1 (DKK1), serpin family H member 1 (SERPINH1), nuclear receptor subfamily 3 group C member 1 (NR3C1), transforming growth factor β 1 (TGFB1), EPH receptor A2 (EPHA2), src-related kinase lacking C-terminal regulatory tyrosine and N-terminal myristylation sites (SRMS), dihydrofolate reductase (DHFR), HCK proto-oncogene, Src family tyrosine kinase (HCK), YES proto-oncogene 1, Src family tyrosine kinase (YES1), LYN proto-oncogene, Src family tyrosine kinase (LYN), FYN proto-oncogene, Src family tyrosine kinase (FYN), aldehyde dehydrogenase 5 family member A1 (ALDH5A1), fyn related Src family tyrosine kinase (FRK), LCK proto-oncogene, Src family tyrosine kinase (LCK), FGR proto-oncogene, Src family tyrosine kinase (FGR), I-10, IL-10 receptor, IL-4, IL-4 receptor, or CCL2.

In some embodiments, the vector or vectors are selected from a DNA, an RNA, a plasmid, a lentiviral vector, an adenoviral vector, or a retroviral vector.

In some embodiments, the vector or vectors further comprise one or more promoters.

In some embodiments, the expression of the FDMM and the CAR is controlled by the same promoter. In some embodiments, the vector or vectors may comprise an IRES sequence or a self-cleaving 2A sequence. The 2A sequence may be T2A, P2A, E2A, or F2A.

In some embodiments, at least one of the vectors is an in vitro transcribed vector.

In some embodiments, at least one of the vectors further comprises a poly A tail and/or a 3'UTR.

The invention further provides a recombinant or isolated cell comprising the CAR according to any of the foregoing embodiments, a recombinant or isolated cell comprising the nucleic acid sequence according to any of the foregoing embodiments, and a recombinant or isolated cell comprising a vector or vectors according to any of the foregoing embodiments.

In some embodiments, the cell may be a mammalian cell. In some embodiments, the cell may be a human or mouse cell. In some embodiments, the cell may be a stem cell. In some embodiments, the cell may be a primary cell or a cell line. In a preferred embodiment, the cell may be a primary human cell or derived therefrom.

In some embodiments, the cell may be an immune cell. The recombinant or isolated immune cell may be $MHC^+$ or $MHC^-$.

In some embodiments, the cell is a cell line, a T cell, a T cell progenitor cell, a CD4+ T cell, a helper T cell, a regulatory T cell, a CD8+ T cell, a naïve T cell, an effector T cell, a memory T cell, a stem cell memory T (TSCM) cell, a central memory T (TCM) cell, an effector memory T (TEM) cell, a terminally differentiated effector memory T cell, a tumor-infiltrating lymphocyte (TIL), an immature T cell, a mature T cell, a cytotoxic T cell, a mucosa-associated invariant T (MAT) cell, a TH1 cell, a TH2 cell, a TH3 cell, a TH17 cell, a TH9 cell, a TH22 cell, a follicular helper T cell, an α/β cell, a δ/γ T cell, a Natural Killer (NK) cell, an eosinophil, a Natural Killer T (NKT) cell, a cytokine-induced killer (CIK) cell, a lymphokine-activated killer (LAK) cell, a perforin-deficient cell, a granzyme-deficient cell, a B cell, a myeloid cell, a monocyte, a macrophage, or a dendritic cell.

In some embodiments, the cell is a T cell, a T cell progenitor cell, a B cell, an NK cell, an eosinophil, an NKT cell, a macrophage, or a monocyte.

In some embodiments, the cell is a T cell or T cell progenitor cell.

In some embodiments, the cell is a T cell which has been modified such that its endogenous TCR is not expressed, is not functionally expressed, or is expressed at reduced levels compared to a wild-type T coll.

In some embodiments, the cell is activated or stimulated to proliferate upon binding of the CAR to its target molecule.

In some embodiments, the cell exhibits cytotoxicity against cells expressing the target molecule when the CAR binds to the target molecule.

In some embodiments, administration of the cell ameliorates a disease, an autoimmune condition, an inflammatory condition, a fibrotic condition, and/or a DAM-associated condition when the CAR binds to its target molecule.

In some embodiments, the cell increases expression of cytokines and/or chemokines when the CAR binds to its target molecule. In a preferred embodiment, the cytokines, chemokine, or related proteins are one or more of GM-CSF, IL-6, RANTES (CCL5), TNF-α, IL-4, IL-10, IL-13, IFN-γ, and granzyme B. In some embodiments, the cytokine is IFN-γ.

In some embodiments, the cell decreases expression of cytokines and/or chemokines when the CAR binds to its target molecule. In some embodiments, the cytokine is TGF-β.

In some embodiments, the cell is activated or stimulated to proliferate upon binding of the CAR to its target molecule.

In some embodiments, binding of the CAR to its target molecule induces the expression or secretion of the FDMM or a precursor of the FDMM.

In some embodiments, the cell according to any of the foregoing embodiments may be further modified to incorporate one or more of the following modifications: to express another CAR, optionally an activating or inhibitory CAR; to comprise a suicide gene that is expressible under specific conditions; to be further specific to one or more antigens; to overexpress pro-survival signals; to reverse anti-survival signals; to overexpress Bcl-xL or Bcl-2; to suppress the expression or inhibit the function of cell death genes, including but not limited to Bak or Bax; to over express hTERT; to eliminate Fas expression; to express a TGF-β dominant negative receptor, to evade immunosuppressive mediators; and/or to comprise a homing mechanism.

In one embodiment, the invention provides a population of cells comprising at least one recombinant or isolated cell according to any of the foregoing embodiments.

In one embodiment, the invention provides a pharmaceutical composition comprising at least one recombinant or isolated cell according to any of the foregoing embodiments. The pharmaceutical composition may farther comprise a pharmaceutically acceptable carrier or excipient. The pharmaceutical composition may further comprise one or more additional agents that specifically bind to one or more molecules associated with a fibrotic or inflammatory condition. The pharmaceutical composition may be suitable for topical, enteral, or parenteral administration.

In some embodiments, the invention provides a method of immune therapy comprising administering to a subject in need thereof a therapeutically effective amount of a CAR or isolated cell or composition according to any of the foregoing.

In some embodiments, the invention provides a method of targeting a disease site with a FDMM in a subject, the method comprising administering to said subject an effective amount of at least one cell according to any of the foregoing embodiments.

In some embodiments, the invention provides a method for stimulating an immune cell-mediated response in a subject, the method comprising administering to a subject in need thereof an effective amount of a cell modified to express a CAR comprising (a) an AB domain that binds to a target molecule which is expressed on DAMs or which is over- or aberrantly-expressed in fibrosis, (b) a TM domain, (c) an ICS domain, (d) optionally a hinge that joins said AB domain and said TM domain, and (e) optionally one or more CS domains, wherein the modified cell is activated or stimulated to proliferate when the CAR binds to its target molecule, thereby stimulating an immune cell-mediated response in the subject, optionally wherein the cell is further modified to express a FDMM.

The method according to any of the foregoing may be used in the treatment of a disease, an autoimmune condition, an inflammatory condition, a fibrotic condition, and/or a DAM-associated condition.

In some embodiments, the invention provides a method for treating a disease, an autoimmune condition, an inflammatory condition, a fibrotic condition, and/or a condition associated with DAMs in a subject, the method comprising administering to the subject in need thereof an effective amount of a cell genetically modified to express a CAR comprising (a) an AB domain that binds to a target molecule which is expressed on DAMs or which is over- or aberrantly-expressed in fibrosis, (b) a TM domain, (c) an ICS domain, (d) optionally a hinge that joins said AB domain and said TM domain, and (e) optionally one or more CS domains, wherein the modified cell is activated or stimulated to proliferate when the CAR binds to its target molecule, thereby treating the disease, autoimmune condition, inflammatory condition, fibrotic condition, and/or a DAM-associated condition, optionally wherein the cell is further modified to express a FDMM.

In some embodiments, the invention provides a method for treating a fibrotic condition in a subject, the method comprising administering to the subject in need thereof an effective amount of a cell modified to express a CAR comprising (a) an AB domain that binds to a target molecule which is expressed on DAMs or which is over- or aberrantly-expressed in fibrosis, (b) a TM domain, (c) an ICS domain, (d) optionally a hinge that joins said AB domain and said TM domain, and (e) optionally one or more CS domains, optionally wherein the cell is further modified to express a FDMM.

In some embodiments, the modified cell is a T cell.

In some embodiments, the T cell is an autologous T cell or a donor-derived T cell; or is derived from pluripotent stem cells, iPS cells, or other stem cells.

In some embodiments, said subject has a fibrotic condition.

In some embodiments, said subject has systemic sclerosis or pulmonary fibrosis.

In some embodiments, said pulmonary fibrosis is idiopathic pulmonary fibrosis.

In some embodiments, the modified cell induces an immune response as measured by increased production of cytokines and chemokines. In some embodiments, the cytokine is IFN-γ.

In some embodiments, the modified cell induces an immune response as measured by reduced production of cytokines and chemokines. In some embodiments, the cytokine is TGF-β.

In some embodiments, the method reduces the incidence or prevalence of aberrant skin thickness.

In some embodiments, the treatment efficacy is assessed via gene expression analysis.

In some embodiments, the cells are administered topically, enterally, or parenterally.

In some embodiments, said subject is a mammal. In some embodiments, the subject is a human or a mouse.

In some embodiments, the method further comprises administration of another therapy to the subject.

In some embodiments, the cells are administered in combination with another therapeutic agent. In some embodiments, the therapeutic agent increases the efficacy of the CAR-expressing cells. In some embodiments, the therapeutic agent ameliorates one or more side effects associated with administration of the CAR-expressing cells. In some embodiments, the therapeutic agent ameliorates a fibrotic or inflammatory condition, optionally wherein the therapeutic agent is a FDMM.

In some embodiments, the cell expresses a CAR or a nucleic acid encoding said CAR according to any one of the foregoing embodiments.

In some embodiments, the invention provides a method of generating a persisting population of modified cells in a subject, the method comprising administering to the subject at least one cell modified to express a CAR according to any of the foregoing embodiments, at least one cell comprising a nucleic acid sequence according to any of the foregoing embodiments, at least one cell comprising a vector or vectors according to any of the foregoing embodiments, or at least one recombinant or isolated cell according to any of the foregoing embodiments, wherein the modified cells persist in the subject for at least one month after administration.

In some embodiments, the persisting population of modified cells comprises at least one modified cell that was administered to the subject, a progeny of the modified cell that was administered to the subject, or a combination thereof.

In some embodiments, the persisting population of modified cells comprises a memory T cell.

In some embodiments, the persisting population of modified cells persists in the subject for at least three months, at least four months, at least five months, at least six months, at least seven months, at least eight months, at least nine months, at least ten months, at least eleven months, at least twelve months, at least eighteen months, at least two years, or at least three years after administration.

In some embodiments, the invention provides a method of expanding a population of modified cells in a subject, the method comprising administering to the subject at least one cell modified to express a CAR according to any of the foregoing embodiments, at least one cell comprising a nucleic acid sequence according to any of the foregoing embodiments, at least one cell comprising a vector or vectors according to any of the foregoing embodiments, or at least one recombinant or isolated cell according to any of the foregoing embodiments, wherein the administered modified cell produces a population of progeny cells in the subject.

In some embodiments, the population of progeny cells persists in the subject for at least three months, at least four months, at least five months, at least six months, at least seven months, at least eight months, at least nine months, at least ten months, at least eleven months, at least twelve months, at least eighteen months, at least two years, or at least three years after administration.

In some embodiments, the invention provides a method of generating a population of RNA-engineered cells comprising introducing an in vitro transcribed RNA or synthetic RNA into a cell, wherein the RNA comprises a nucleic acid encoding a CAR molecule according to any of the foregoing embodiments.

In some embodiments, the invention provides an Ab, or AB portion thereof, which specifically binds to the CAR according to any of the foregoing embodiments, which optionally can be used to detect the expression of the CAR on host cells, and which further optionally does not bind to endogenously expressed proteins. In some embodiments, the invention provides a method of using this antibody to evaluate CAR transduction efficiency, to select for CAR-expressing cells, or to remove CAR-expressing cells from a sample or subject.

In some embodiments, the invention provides a method of generating a CAR-expressing cell, comprising introducing into a cell a nucleic acid sequence encoding a CAR according to any of the foregoing embodiments or a nucleic acid sequence according to any any of the foregoing embodiments.

In some embodiments, the invention provides a method of generating a CAR-expressing cell, optionally expressing a FDMM, comprising transducing a cell with a vector or vectors according to any of the foregoing embodiments.

In some embodiments, the CAR-expressing cell is isolated based on expression of said CAR and/or a selectable marker as determined via flow cytometry or immunofluorescence assays.

DETAILED DESCRIPTION OF THE SEVERAL VIEWS OF THE DRAWINGS

FIG. 1 shows a general schematic of CARs of the present invention.

Figure 2:
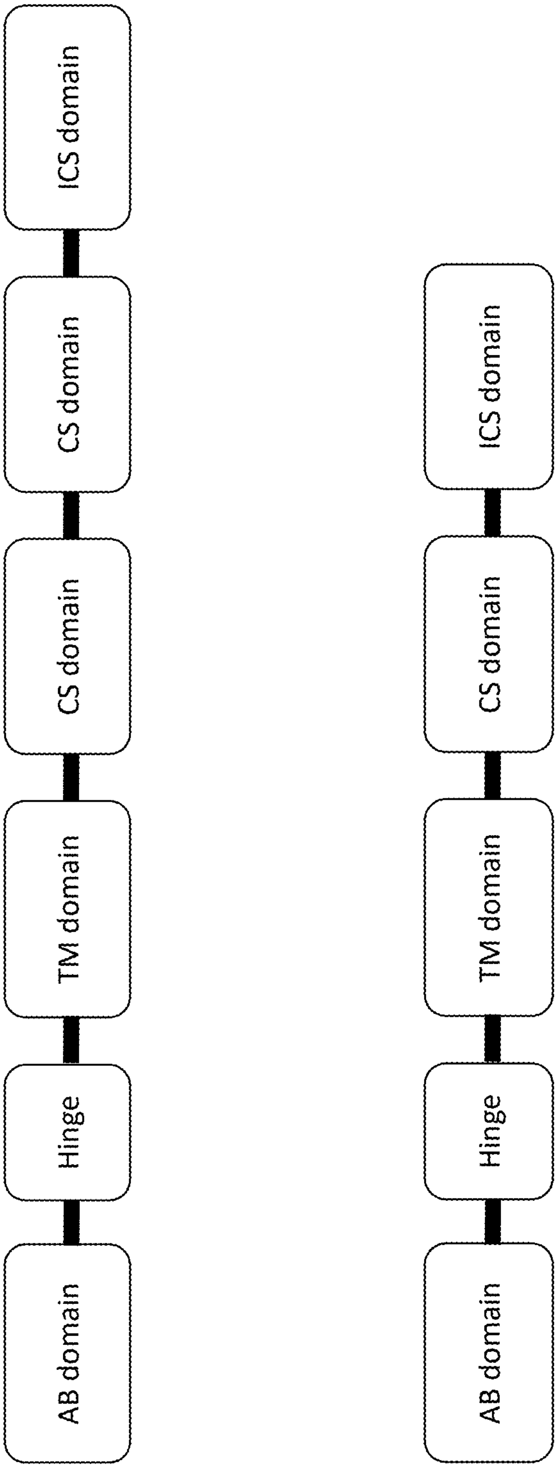

FIG. 2 shows two exemplary schematics of CAR constructs of the present invention. The left example comprises an AB domain, a TM domain, an ICS domain, and further comprises a hinge that joins the AB and TM domains, and a CS domain. The right example comprises an AB domain, a TM domain, an ICS domain, and further comprises a hinge that joins the AB and TM domains, and two CS domains.

Figure 3:
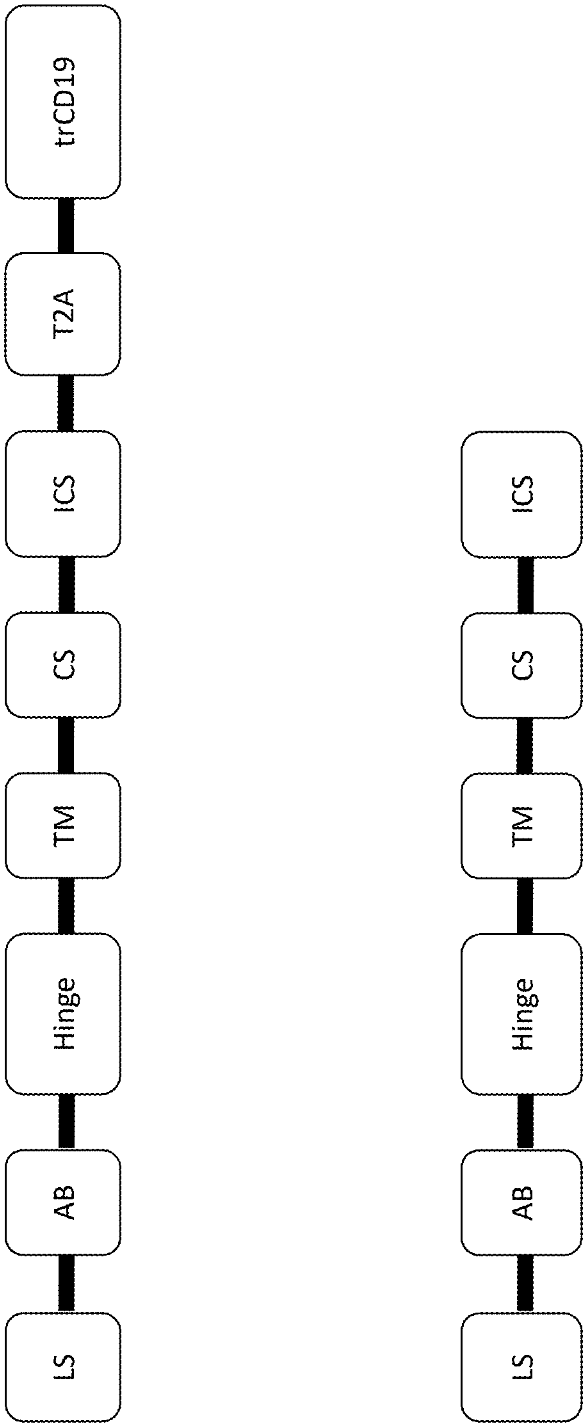

FIG. 3 shows two exemplary schematics of vector constructs encoding a CAR of the present invention. The left example in FIG. 3 comprises a leader sequence (LS) and an exemplary CAR construct as shown in the left example in FIG. 2. The right example in FIG. 3 further comprises an exemplary ribosomal skip sequence (T2A) and an exemplary expression/purification marker, truncated CD19 (trCD19).

Figure 4A:
Figure 4B:
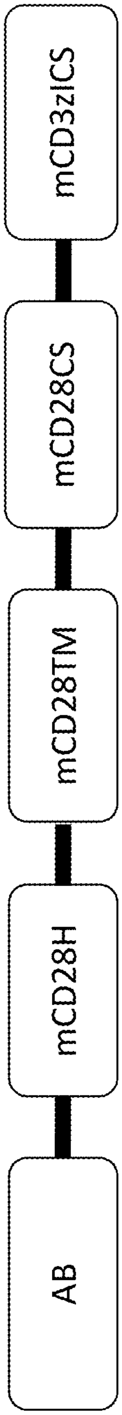

FIGS. 4A and 4B show exemplary schematics of a CAR construct of some embodiments. The construct comprises an AB domain, a TM domain, an ICS domain, and further comprises a hinge that joins the AB and TM domains, and a CS domain. In the example in FIG. 4A, the hinge is derived from human CD28 (referred to as CD28H herein), the TM domain is derived from the TM region of human CD28 (referred to as CD28TM herein), the CS region is derived from a cytoplasmic signaling sequence of human CD28 (referred to as CD28CS herein), and the ICS domain is derived from a cytoplasmic signaling sequence of human CD3 zeta (referred to as CD3zICS herein). In the example in FIG. 4B, the hinge is derived from mouse CD28 (referred to as mCD28K herein), the TM domain is derived from the TM region of mouse CD28 (referred to as mCD28TM herein), the CS region is derived from a cytoplasmic signaling sequence of mouse CD28 (referred to as mCD28CS herein), and the ICS domain is derived from a cytoplasmic signaling sequence of mouse CD3 ζ (referred to as mCD3zICS herein).

Figure 5:
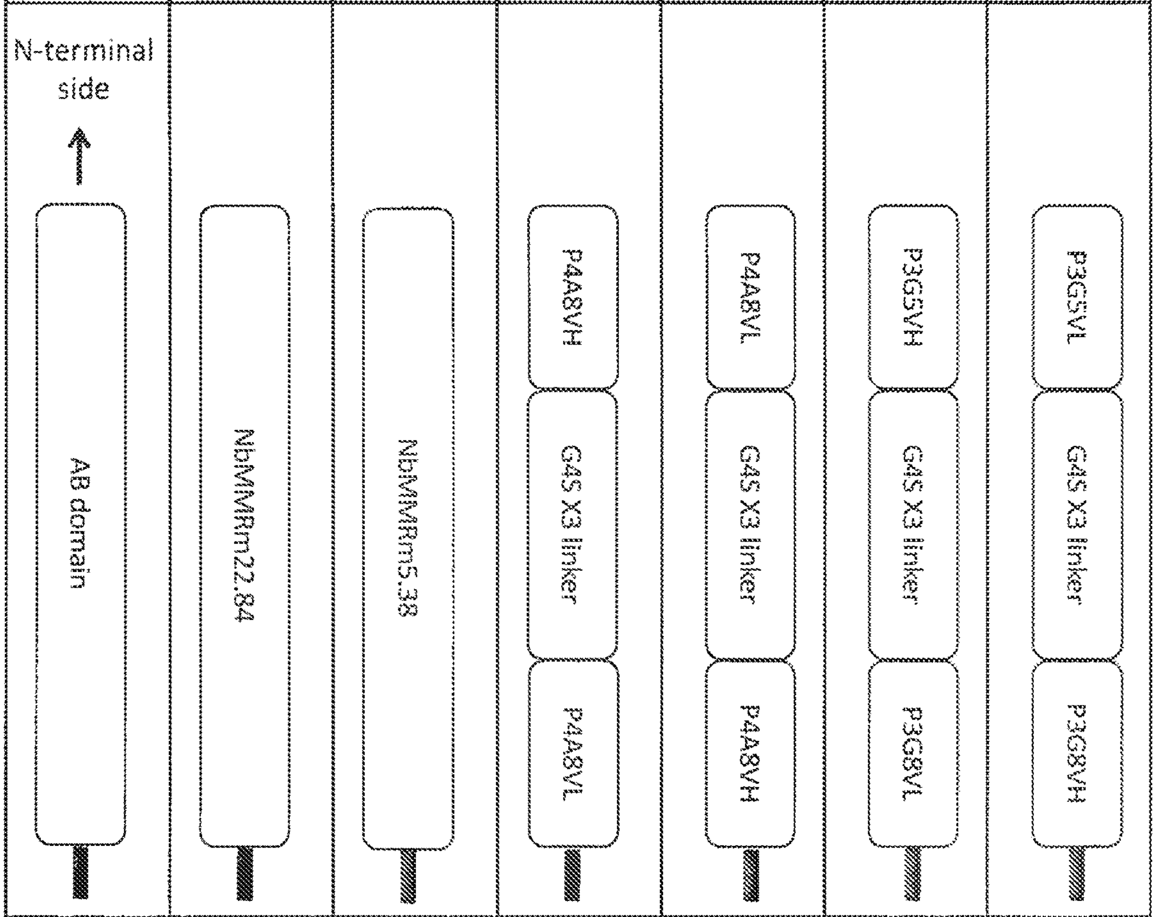

FIG. 5 illustrates a schematic showing various exemplary AB domain constructs of CARs of some embodiments. Two examples are nanobodies specific for CD206 (NbMMRm22.84 and NbMMRm5.38). NbMMRm22.84 may also be also referred to as Nb22.84, Nb2284, 22.84, or 2284. NbMMRm5.38 may also be also referred to as Nb5.38, Nb538, 5.38, or 538. Four examples are scFvs specific for Fn14, two derived from antibody AbP4A8 and two derived from antibody AbP3G5. In scFvs, the heavy chain variable domain (VH) may be placed N-terminally upstream of the light chain variable domain ($V_L$), and the $V_H$ and $V_L$ may optionally be linked via a linker (for example, the G4S X3 linker). In this case, when the scFv is derived from AbP4A8, the construct may be referred to as AbP4A8 $V_HV_L$, scFvP4A8 $V_HV_L$, scFvAbP4A8 $V_HV_L$, P4A8 $V_HV_L$, P4A8HL, 4A8HL, or 4A8H. When the scFv is derived from AbP3G5, the construct may be referred to as AbP3G5 $V_HV_L$, scFvP3G5 $V_HV_L$, scFvAbP3G5 $V_HV_L$, P3G5 $V_HV_L$, P3G5HL, 3G5HL, or 3G5H. Alternatively, the heavy chain variable domain (VH) may be placed downstream of the light chain variable domain ($V_L$), and the $V_H$ and $V_L$ may optimally be linked via a linker (for example, the G4S X3 linker). In this case, when the scFv is derived from AbP4A8, the construct may be referred to as AbP4A8$V_LV_H$, scFvP4A8 $V_LV_H$, scFvAbP4A8 $V_LV_H$, P4A8 $V_LV_H$, P4A8LH, 4A8LH, or 4A8L. When the scFv is derived from AbP3G5, the construct may be referred to as AbP3G5 $V_LV_H$, scFvP3G5 $V_LV_H$, scFvAbP3G5 $V_LV_H$, P3G5 $V_LV_H$, P3G5LH, 3G5LH, or 3G5L. The same naming rules apply to other similar constructs herein. Amino acid (AA) and nucleic acid (NA) sequence identifiers for each of the exemplary constructs are also provided, and are provided throughout the figures.

FIGS. 6A and 6B illustrate schematics showing various exemplary CAR constructs of some embodiments of the invention. In the exemplary constructs in FIG. 6A, any one of the six AB domains shown in FIG. 5 is used as the AB domain, CD28H is used as the hinge, CD28TM is used as the TM domain, CD28CS is used as the CS domain, and CD3zICS is used as the ICS domain. In the exemplary constructs in FIG. 6B, any one of the six AB domains shown in FIG. 5 is used as the AB domain, mCD28H is used as the hinge, mCD28TM is used as the TM domain, mCD28CS is used as the CS domain, and mCD3zICS is used as the ICS domain.

FIG. 7A-7C illustrate schematics showing various vector constructs that may be used for expressing an exemplary CAR of some embodiments. In this example, the pFB vector was used. In FIG. 7A, the exemplary vector encodes a leader sequence (LS), any one of the six AB domains shown in FIG. 5 for the AB domain, CD28H for the hinge, CD28TM for the TM domain, CD28CS for the CS domain, and CD3zICS for the ICS domain. In FIG. 7B, the exemplary vector further encodes T2A as a ribosomal skip sequence and truncated CD19 (trCD19) as an expression/purification marker. The T2A$^+$trCD19 construct may be referred to as T2A-trCD19, T2A-tCD19, or t19 herein. In FIG. 7C, the exemplary vector encodes a leader sequence (LS), any one of the six AB domains shown in FIG. 5 for the AB domain, mCD28H for the hinge, mCD28TM for the TM domain, mCD28CS for the CS domain, mCD3zICS for the ICS domain, T2A as a ribosomal skip sequence and mouse truncated CD19 (mtrCD19) as an expression/purification marker.

Figure 8:
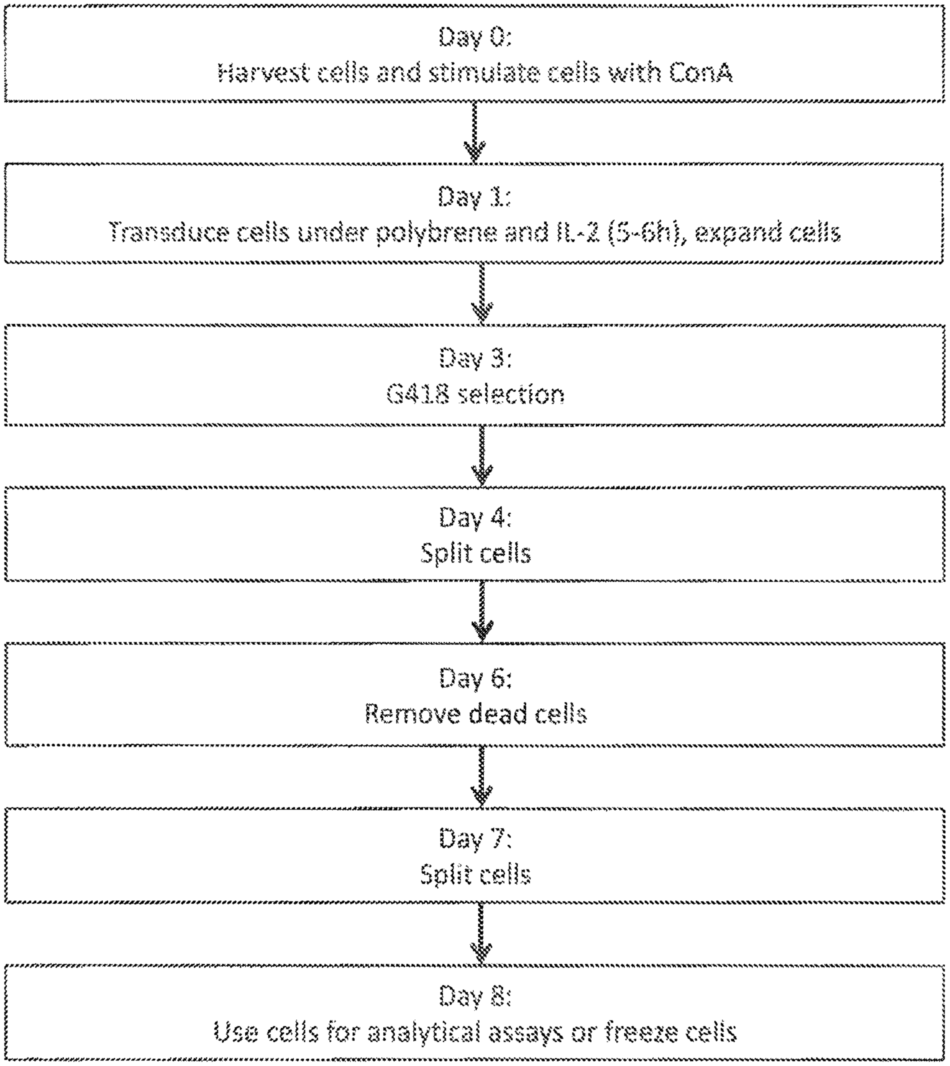

FIG. 8 shows a flow chart illustrating a potential method for manufacturing isolated CAR-expressing cells that may be used for in vitro or in vivo assays.

Figure 9:
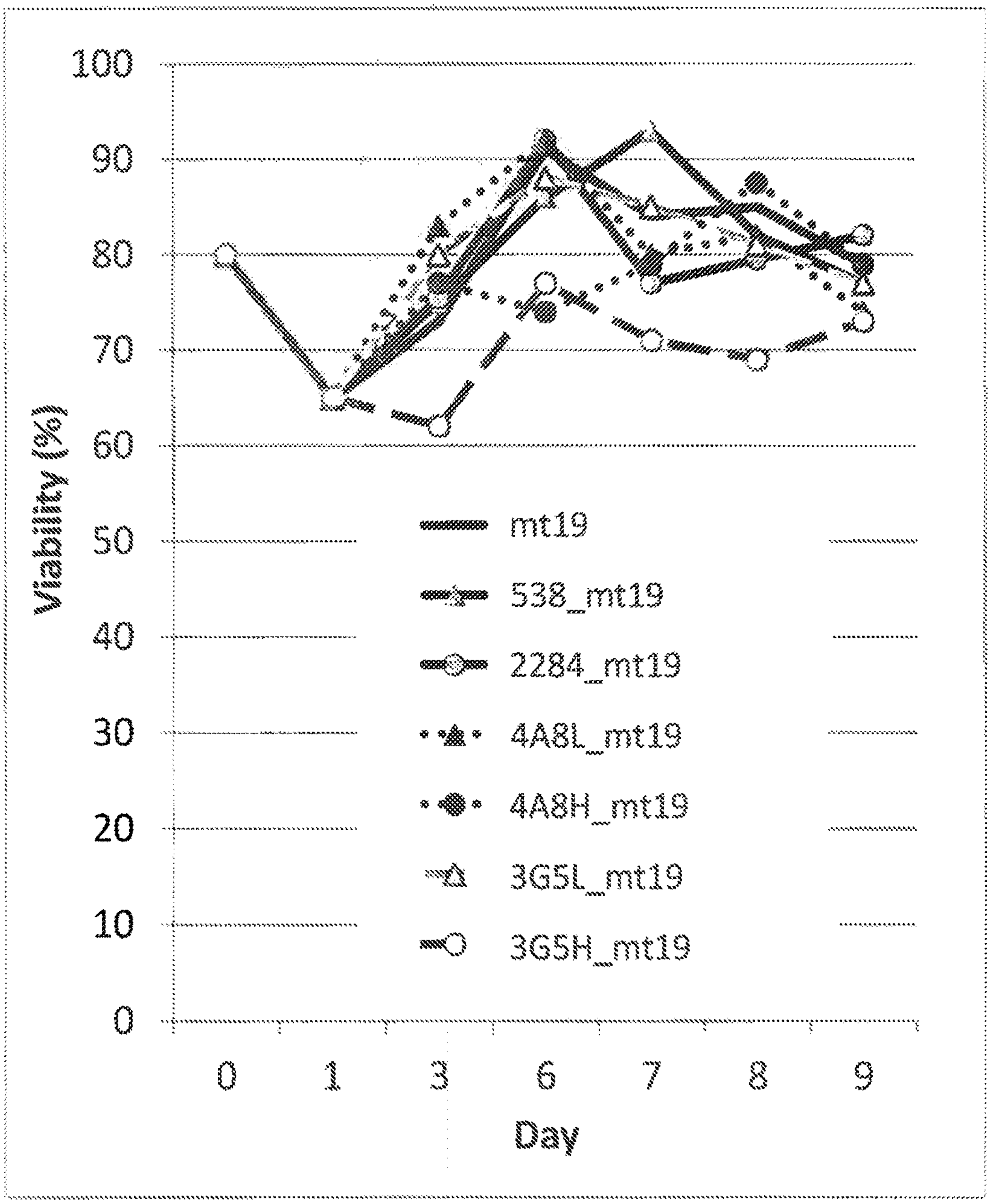

FIG. 9 shows a graph showing the viability of cells manufactured as shown in FIG. 8, evaluated from Day 0 to Day 9. Cells transduced with the vectors encoding anti-CD206 CAR (construct 538_mt19 or 2284_mt19), the vectors encoding anti-Fn14 CAR (construct 4A8L_mt19, 4A8H_mt19, 3G5L_mt19, or 3G5H_mt19), or the vector encoding just mtrCD19 (mt19) were used. Greater than 60% cell viability was observed for each cell transduction condition on each day observed.

Figure 10A:
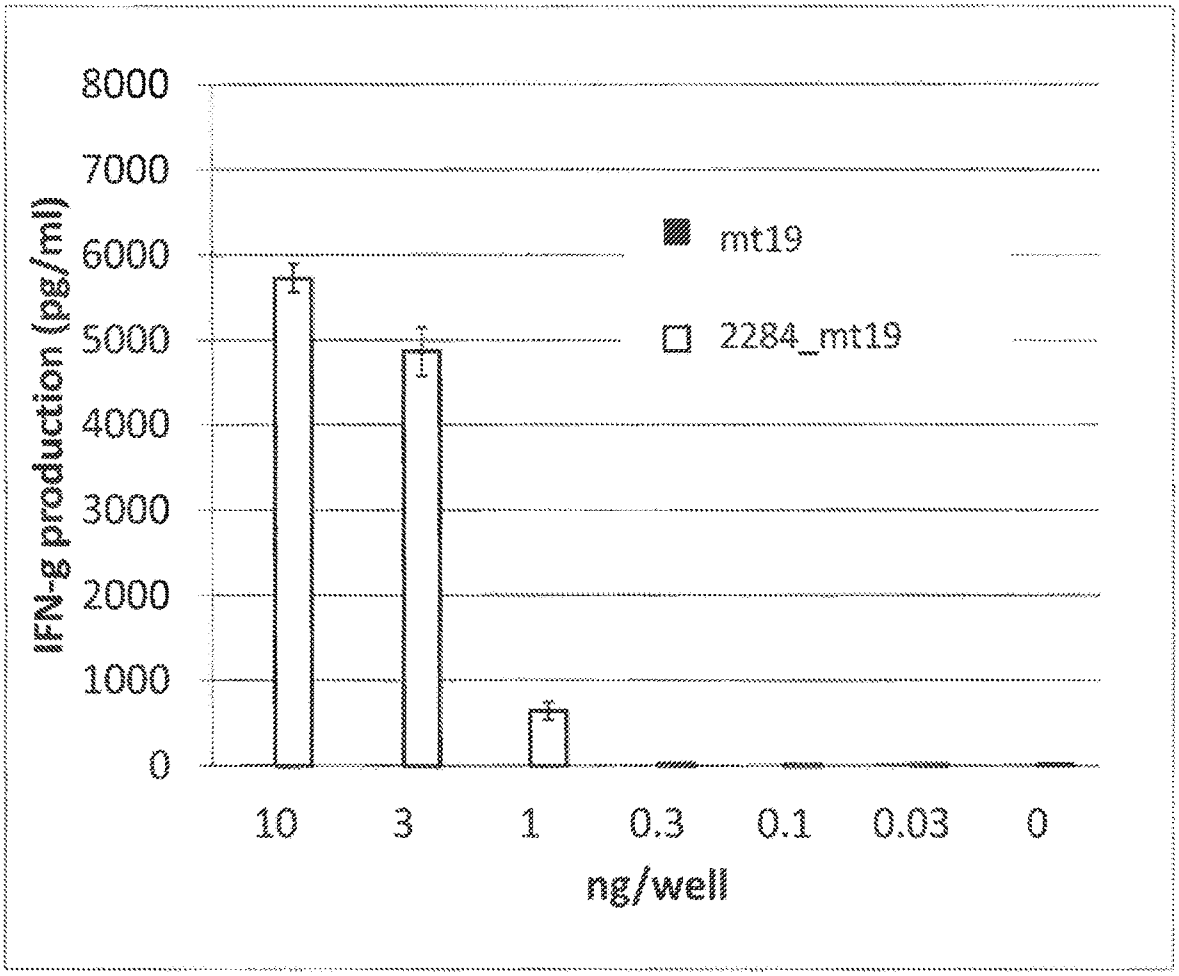
Figure 10B:
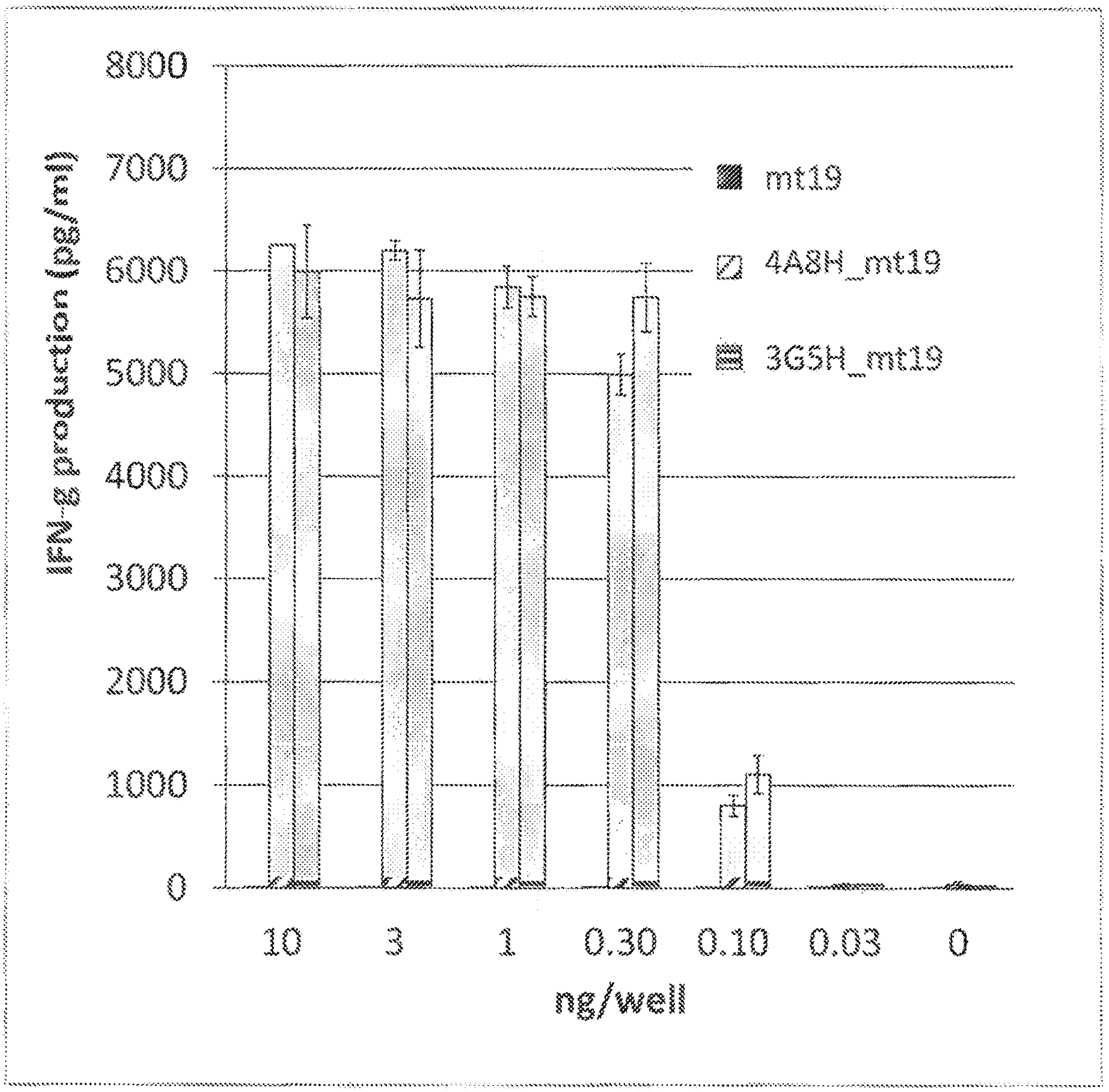

FIGS. 10A and 10B show graphs reporting the IFN γ production upon exposure to plate-bound recombinant Fn14 protein by cells manufactured as shown in FIG. 8, assessed by ELISA. FIG. 10A shows the IFN γ production upon exposure to recombinant CD206 by cells transduced with the vector encoding anti-CD206 (2284_mt19, white bars) or just mtrCD19 (mt19, black bars). FIG. 10B shows the IFN γ production upon exposure to recombinant Fn14 by cells transduced with the vector encoding anti-Fn14 CAR (4A8H_mt19, bars with diagonal lines; or 3G5H_mt19, bars with horizontal lines) or just mtrCD19 (mt19, black bars).

Figure 11:
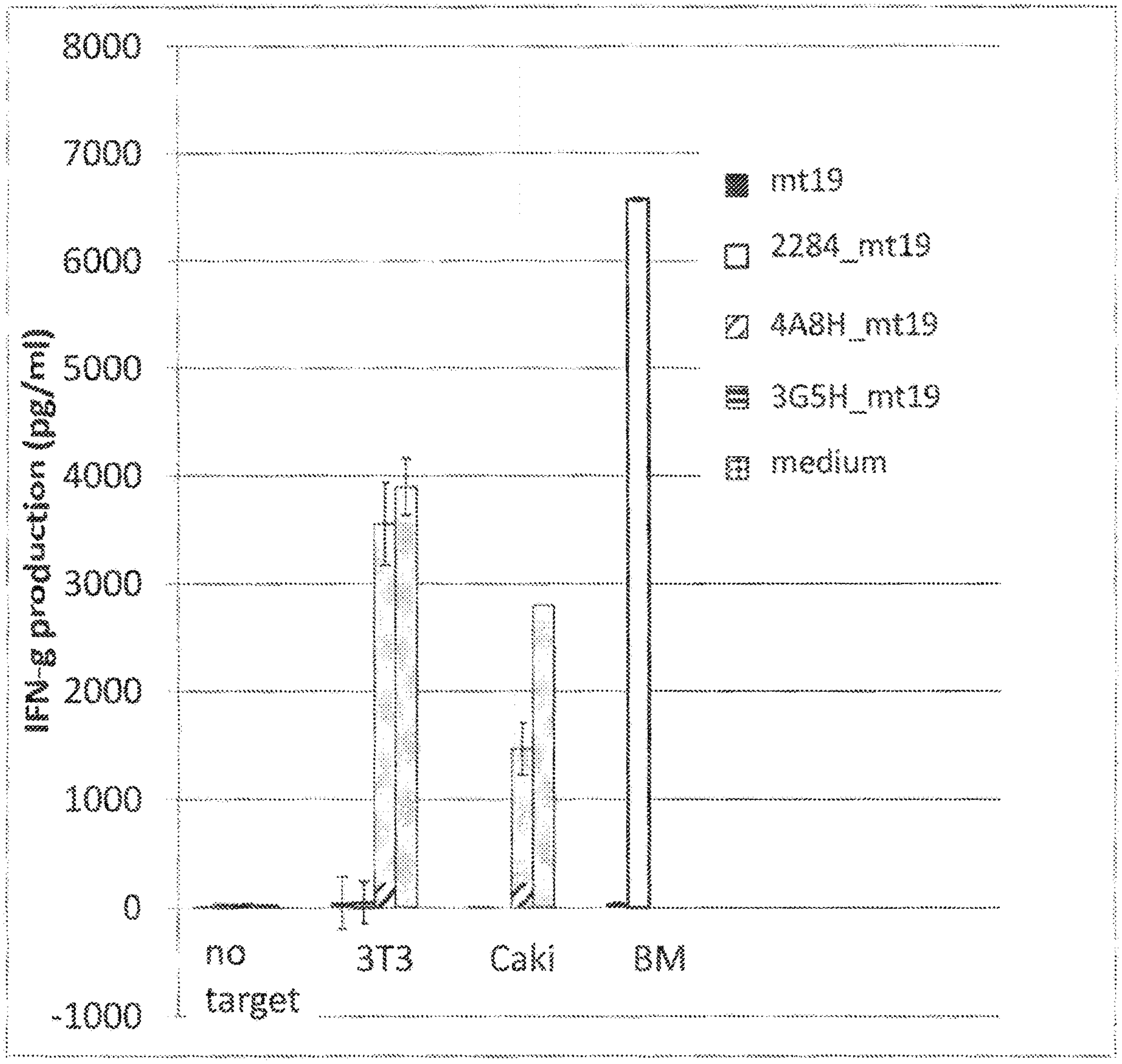

FIG. 11 shows a graph reporting the IFN γ production upon exposure to target cells by cells manufactured as shown in FIG. 8, assessed by ELISA. 3T3 cells and Caki cells were used as Fn14 target cells, and bone marrow (BM) cells were used as CD206 target cells. Cells transduced with the vectors encoding anti-CD206 CAR (construct 2284_mt19, white bars), the vectors encoding anti-Fn14 CAR (construct 4A8H_mt19, bars with diagonal lines; or 3G5H_mt19, bars with horizontal lines), or the vector encoding just mtrCD19 (mt19, black bars) were used. Samples without target cells ("no target") and samples without transduced cells ("medium," bars with checkered lines) were negative controls.

Figure 12A:
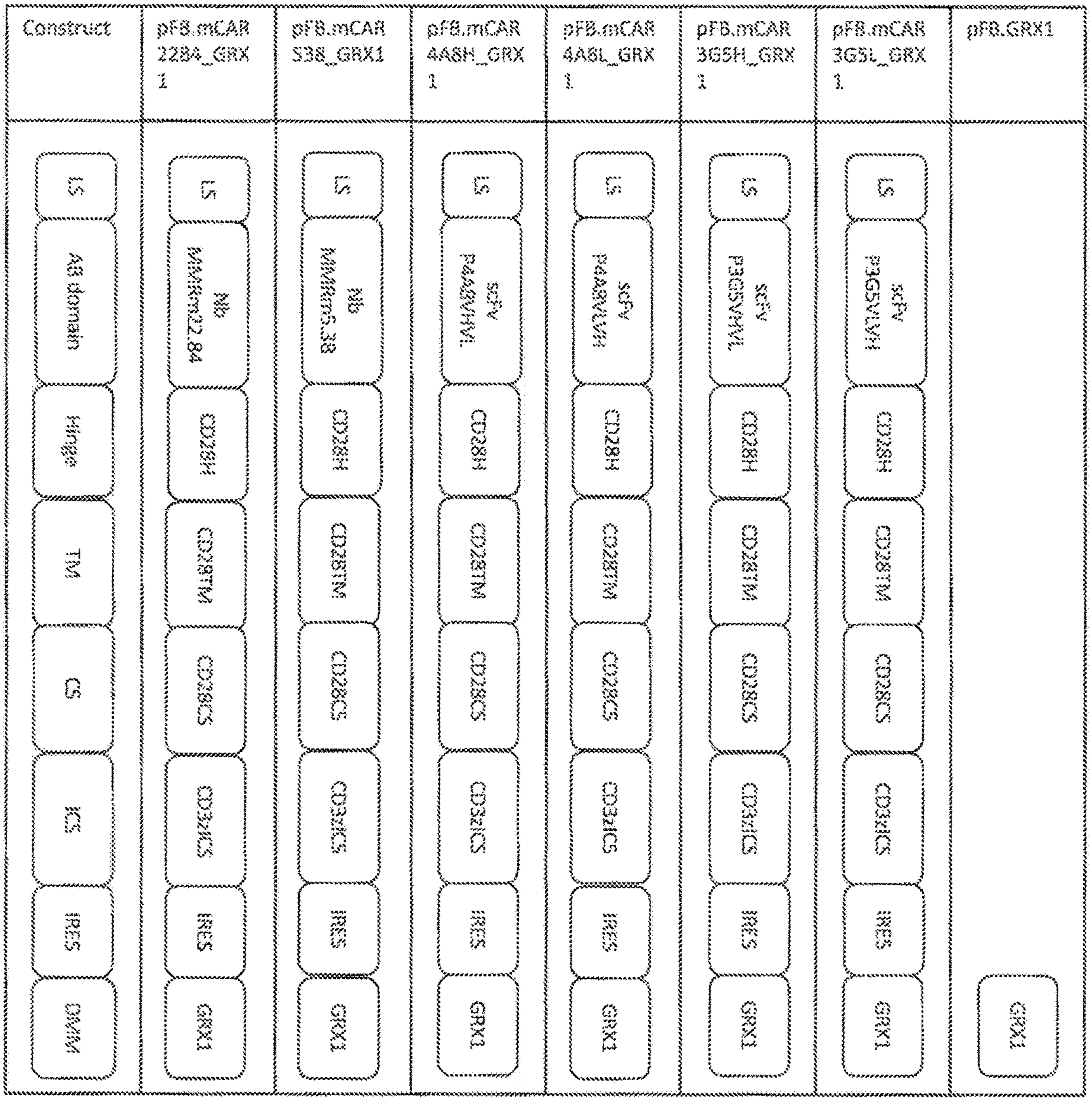
Figure 12B:
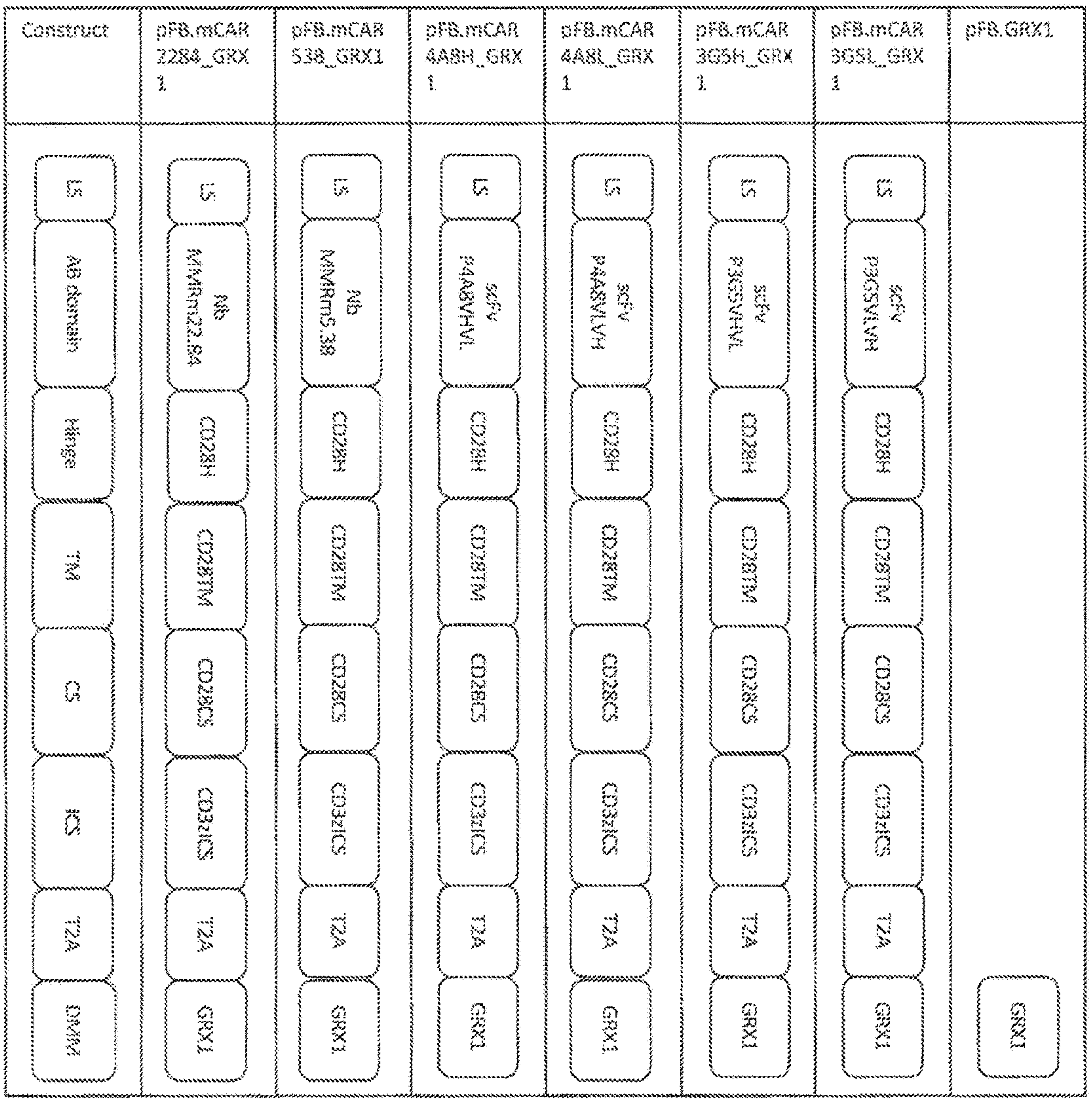

FIGS. 12A and 12B illustrate schematics showing various exemplary vector constructs that may be used for expressing an exemplary CAR of some embodiments and an FDMM in the same cell, by expressing the CAR and FDMM with the same promoter in cis using one vector construct. The shown examples utilize GRX1 as the FDMM. The pFB or SFG retroviral vector may be used. In FIG. 12A, the exemplary vector encodes a leader sequence (LS), one of the six exemplary CARs as shown in FIG. 6, IRES sequence, and GRX1. In FIG. 12B, the exemplary vector further encodes T2A instead of IRES. The T2A$^{+}$trCD19 construct may be referred to as T2A-trCD19, T2A-tCD19, or t19 herein.

Figure 13A:
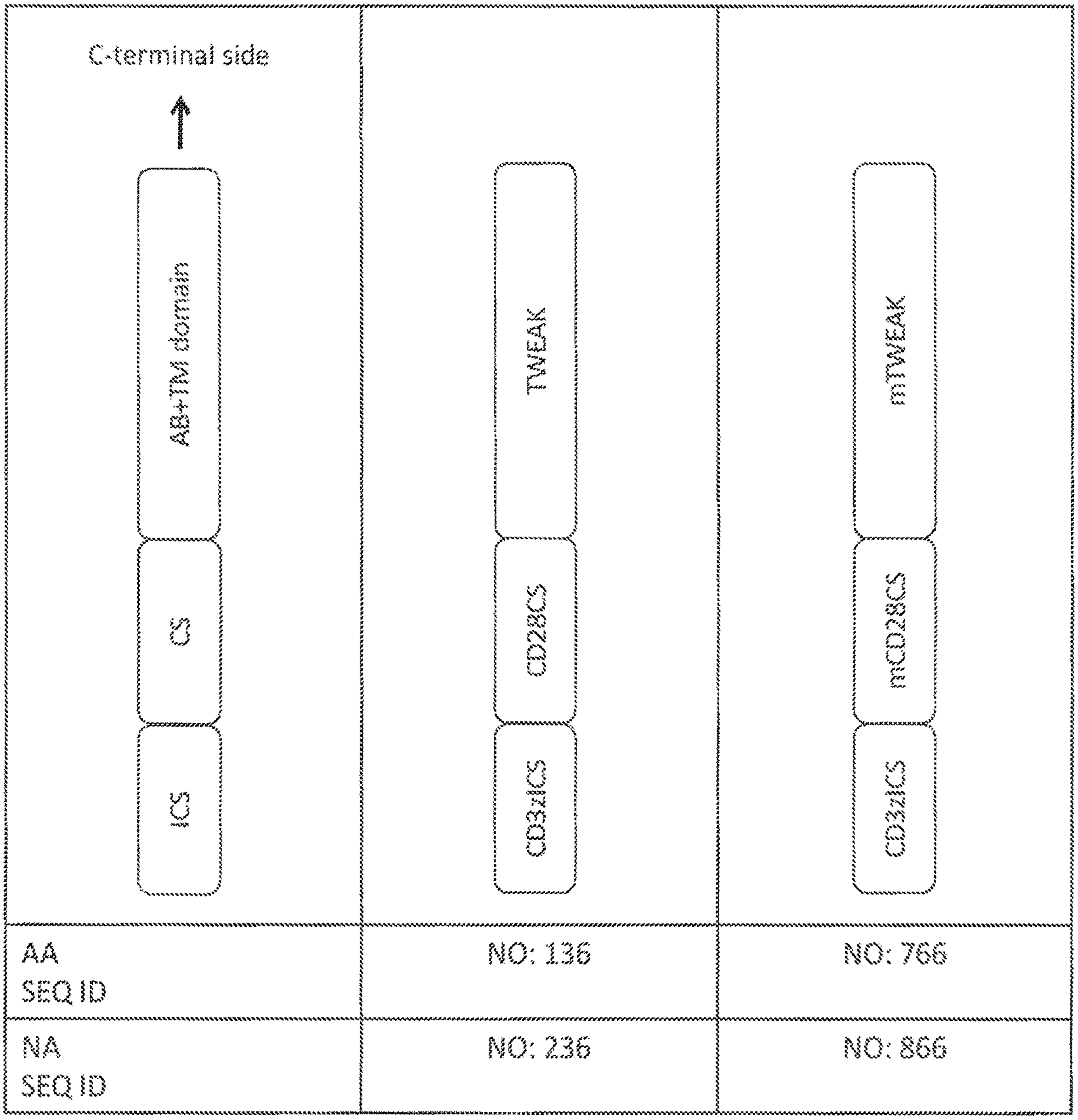
Figure 13B:
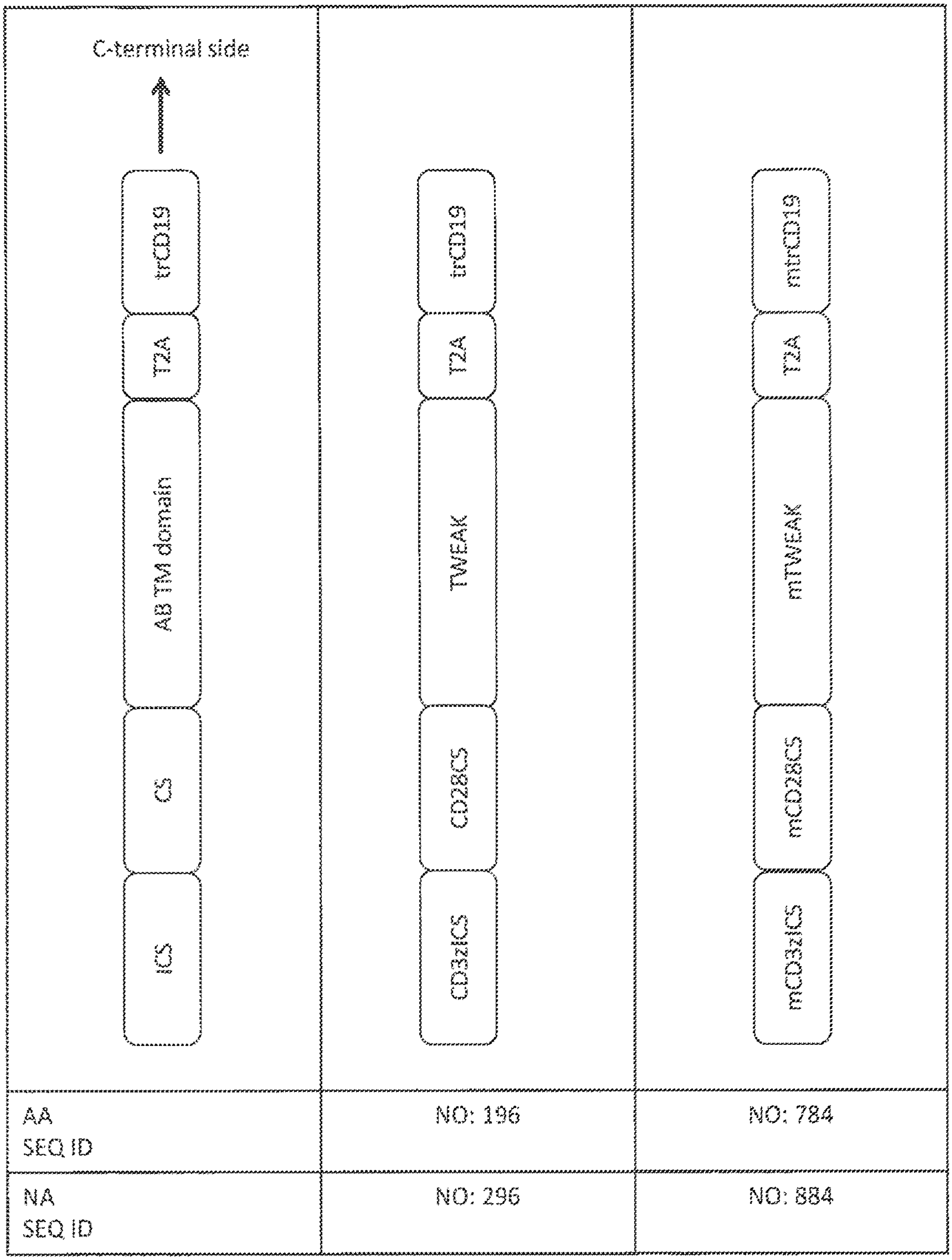
Figure 13C:
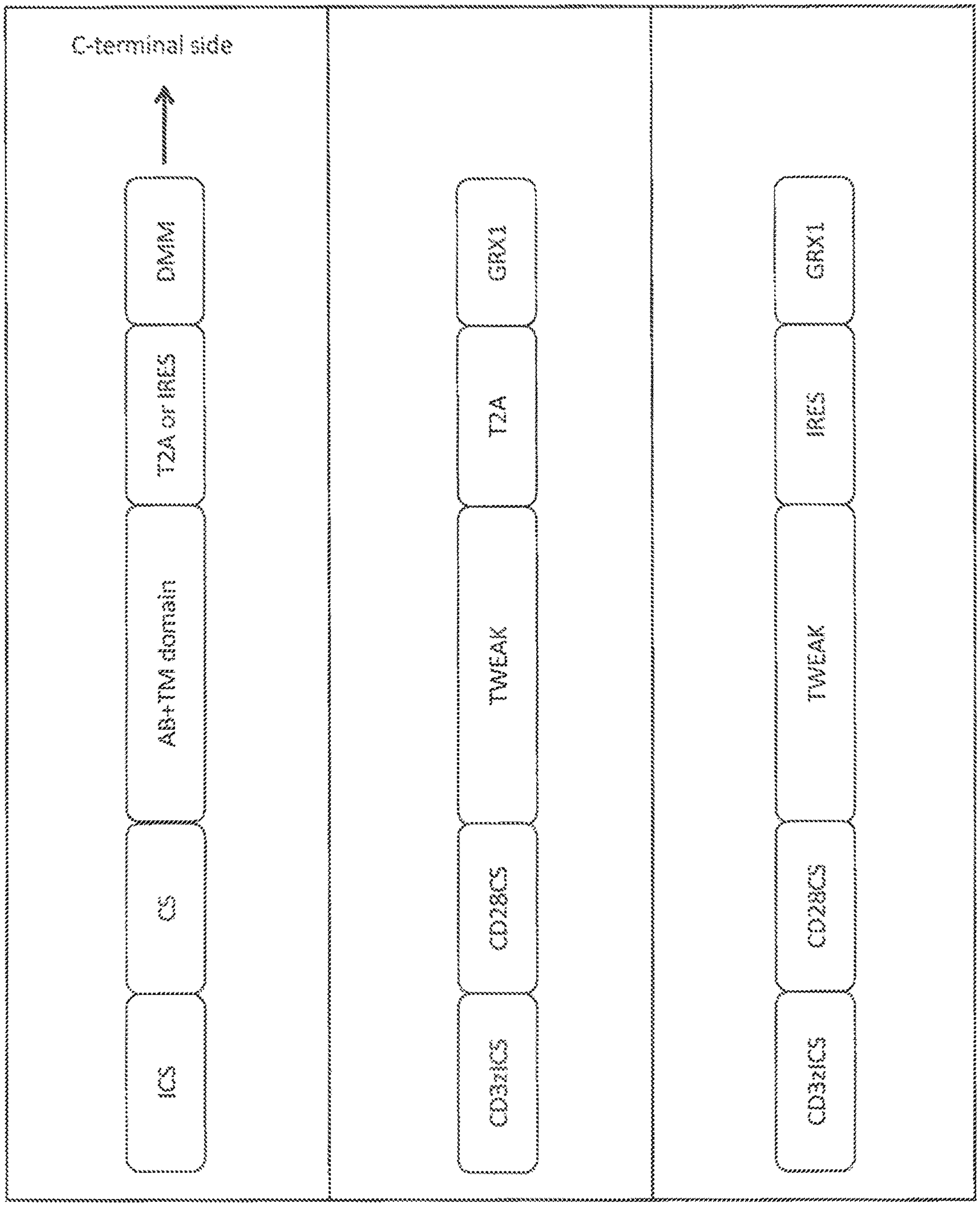

FIGS. 13A, 13B, and 13C illustrate schematics showing various exemplary CAR constructs of some embodiments, in which the AB domain is derived from TWEAK. In the exemplary constructs in FIG. 13A, the general CAR construct (left) comprises an ICS domain, a CS domain, and an AB+TM domain (i.e., an AB domain and a TM domain combined). In one exemplary construct (middle), CD3z is used as the ICS domain, CD28CS is used as the CS domain, and TWEAK (human TWEAK without the first methionine) is used as the AB+TM domain. This construct is suitable for use in humans. In the other exemplary construct (right), mCD3z is used as the ICS domain, mCD28CS is used as the CS domain, and mTWEAK (mouse TWEAK without the first methionine) is used as the AB+TM domain. This construct is suitable for use in mice. Since TWEAK is a type II membrane protein, no leader sequence is needed to express the CAR on the cell surface. FIG. 13B illustrate schematics showing various vector constructs that may be used for expressing exemplary CARs, such as the ones shown in FIG. 13A, and also expressing truncated CD19 (of human or mouse). FIG. 13C illustrate schematics showing various exemplary vector constructs that may be used for expressing an exemplary CAR, such as the ones shown in FIG. 13A, and an FDMM in the same cell, by expressing CAR and FDMM under the same promoter in cis using one vector construct. The shown examples utilize GRX1 as the FDMM. The pFB or SFG retroviral vector may be used.

Figure 14:
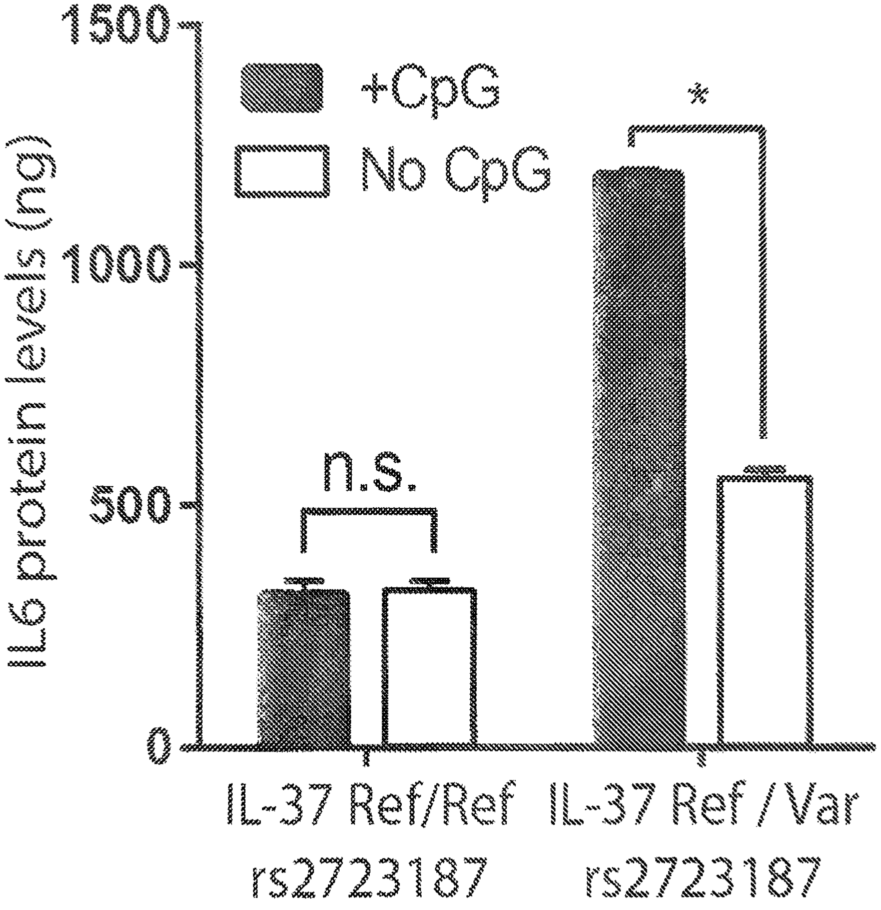

FIG. 14 shows an experiment result that demonstrates that IL-37 Rs2723187 variant increases IL-6 levels in response to CpG stimulation. Four different Hapmap immortalized B cell lines were stimulated with CpG for 72 hours. GM18500 and GM18501 are homozygous reference for rs2723187 (C/C; IL-37 Ref/Ref); GM18503 and GM18504 are heterozygous (C/T; IL-37 Ref/Var). IL-6 ELISA assay results show cell lines with the IL-37 SNP produce increased IL-6 ($p<0.01$) in response to CpG stimulation.

Figure 15A:
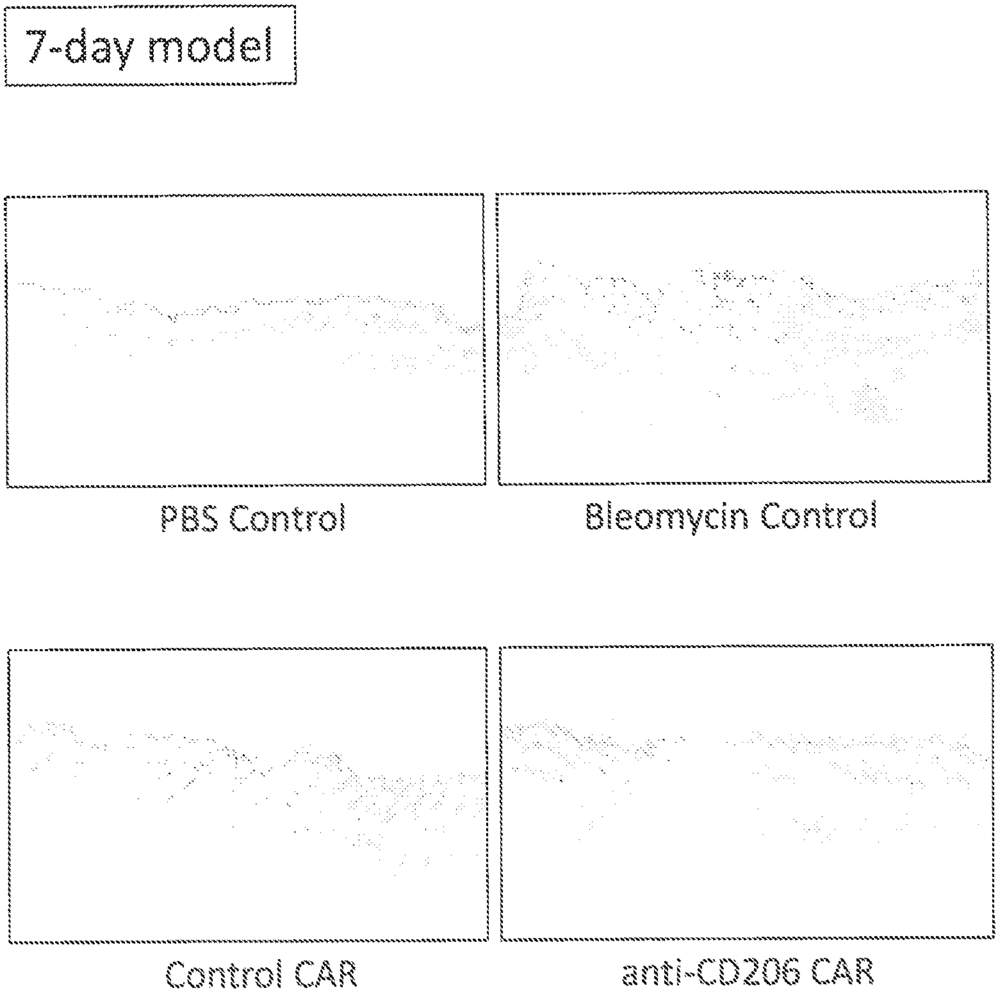

FIG. 15A shows representative H&E staining of the skin sections from mice without SSc induction (PBS Control), SSc mice (SSC induced using the 7-day bleomycin model) administered with HBSS (Bleomycin Control), SSc mice administered with control CAR T cells (Control CAR), and SSc mice administered with anti-CD206 CAR T cells (anti-CD206 CAR).

Figure 15B:
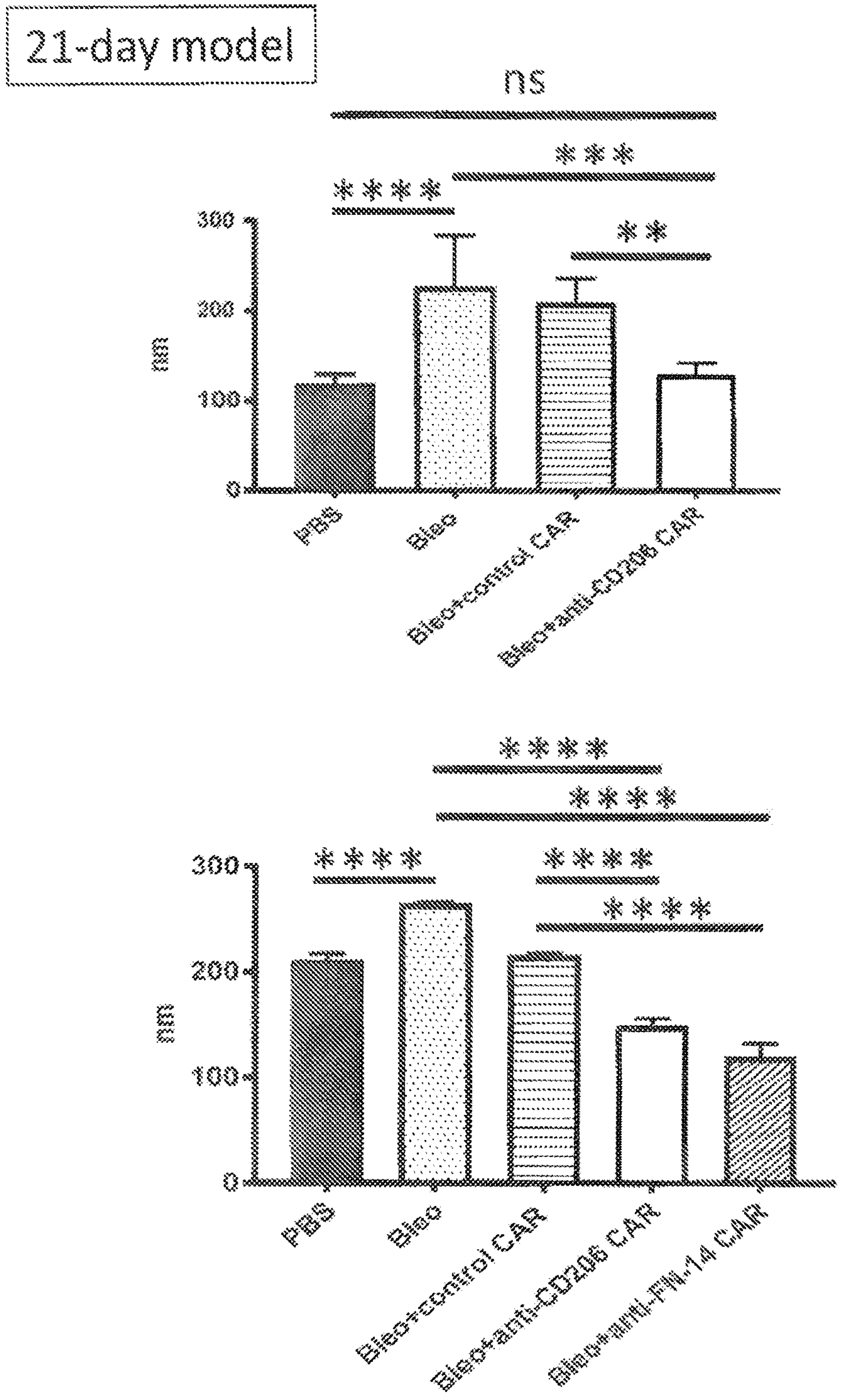

FIG. 15B shows representative dermal thickness (top) and adipose tissue thickness (bottom) comparisons in the 21-day bleomycin model, analyzed using the skin sections from mice without SSc induction (PBS), SSc mice (SSC induced using the 21-day bleomycin model) administered with HBSS (Bleo), SSc mice administered with control CAR T cells (Control CAR), SSc mice administered with anti-CD206 CAR T cells (anti-CD206 CAR), and SSc mice administered with anti-Fn14 CAR T cells (anti-Fn4 CAR). 6 mic (top) or 4 mice (bottom) were used per group. Statistical differences between groups were analyzed using one-way ANOVA (**$p<0.0001$; *$p<0.001$; **$p<0.01$; *$p<0.05$; ns=not significant).

Figure 16A:
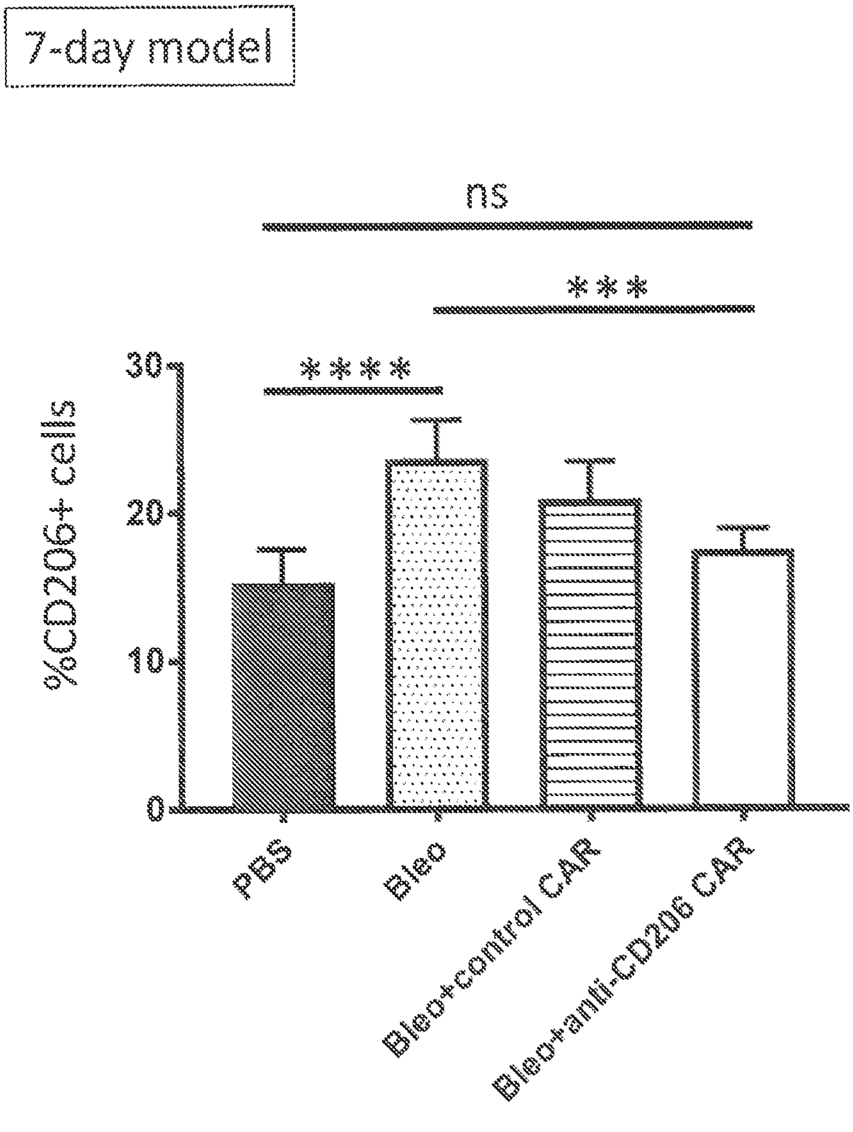

FIG. 16A shows representative comparison of % CD206+ cells among live CD45+ cells in the skin, analyzed using the skin sections from mice without SSc induction (PBS), SSc mice (SSC induced using the 7-day bleomycin model) administered with HBSS (Bleo), SSc mice administered with control CAR T cells (Bleo+control CAR), and SSc mice administered with anti-CD206 CAR T cells (Bleo+anti-CD206 CAR). 6 mice were used per group. Statistical differences between groups were analyzed using one-way ANOVA (**$p<0.0001$; *$p<0.001$; **$p<0.01$; *$p<0.05$; ns=not significant).

Figure 16B:
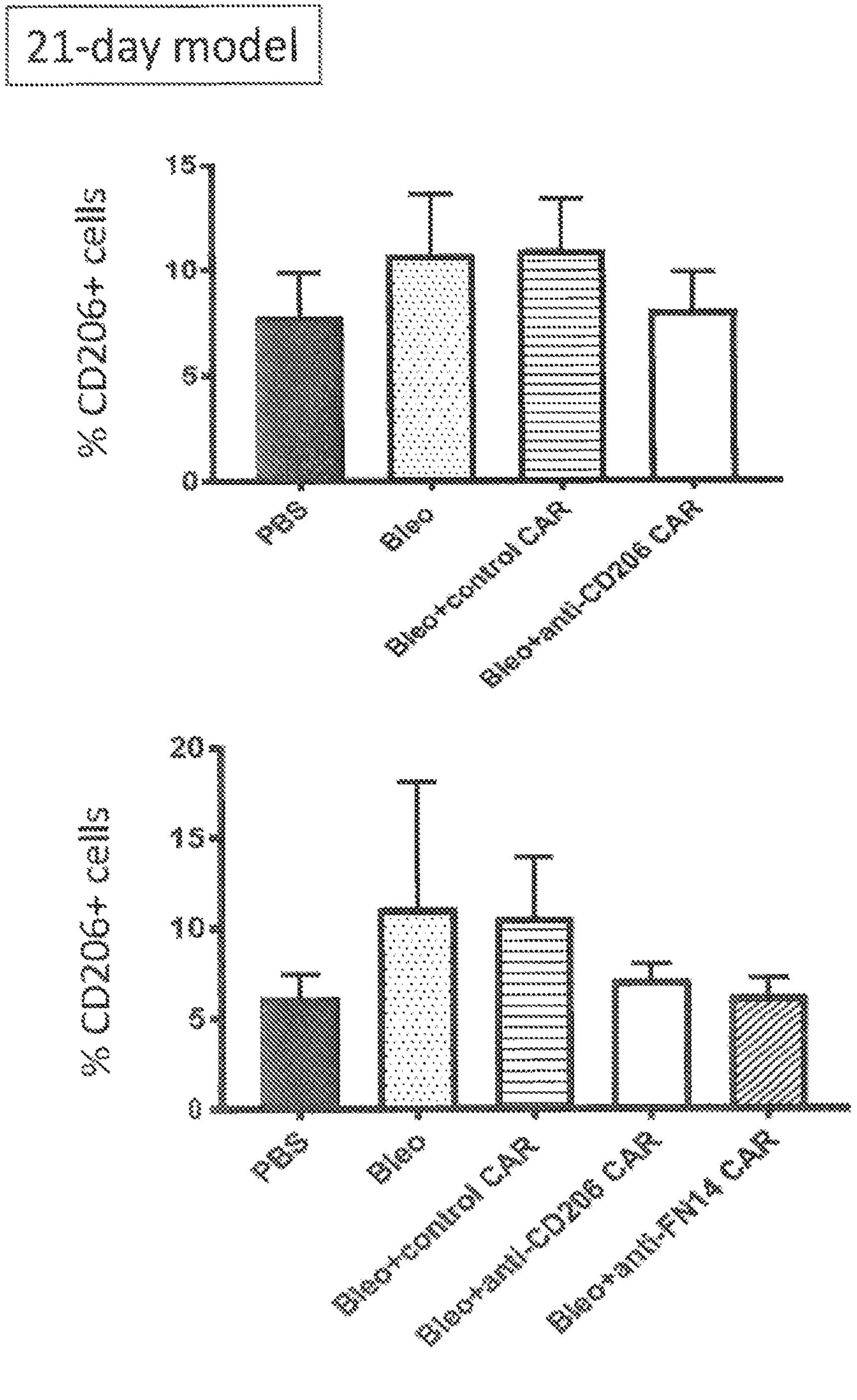

FIG. 16B shows representative comparison of % CD206+ cells among live CD45+ cells in the skin, analyzed using the skin sections from mice without SSc induction (PBS), SSc mice (SSC induced using the 21-day bleomycin model) administered with HBSS (Bleo), SSc mice administered with control CAR T cells (Bleo+control CAR), SSc mice administered with anti-CD206 CAR T cells (Bleo+anti-CD206 CAR), and optionally SSc mice administered with anti-Fn14 CAR T cells (anti-Fn14 CAR). The two graphs (top and bottom) are derived from two independent experiments. 6 mice (top) or 4 mice (bottom) were used per group. Statistical differences between groups were analyzed using one-way ANOVA.

Figure 17A:
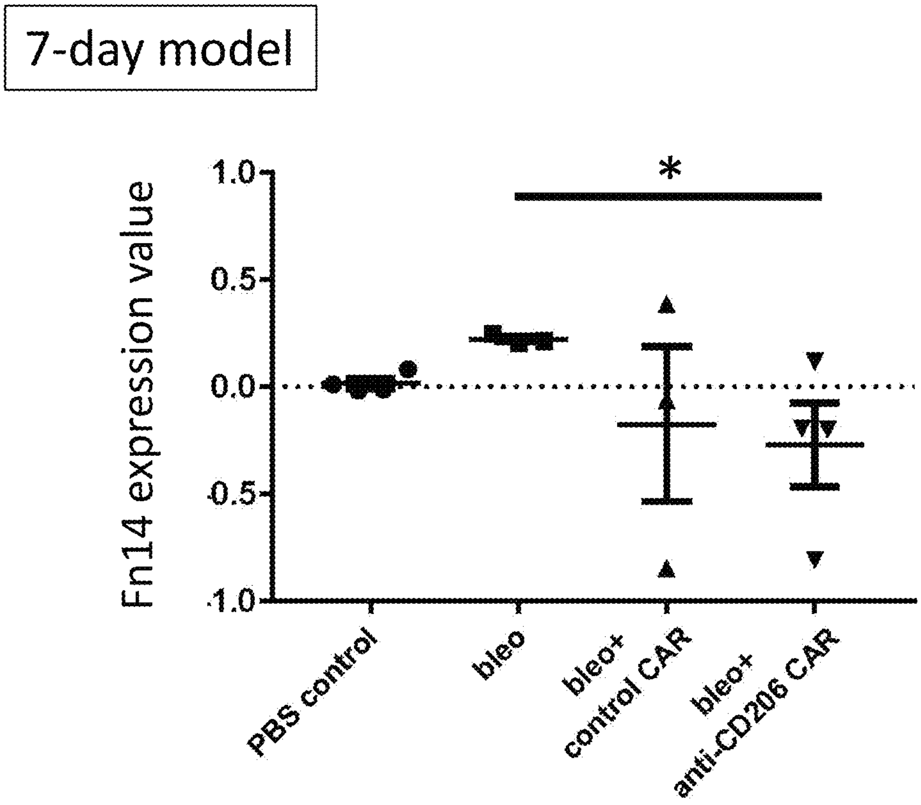

FIG. 17A shows representative comparison of Fn14 RNA expression levels in the skin, analyzed by microarray using the skin sections from mice without SSc induction (PBS control; 4 mice), SSc mice (SSC induced using the 7-day bleomycin model) administered with HBSS (bleo; 3 mice), SSc mice administered with control CAR T cells (bleo+ control CAR; 3 mice), and SSc mice administered with anti-CD206 CAR T cells (bleo+anti-CD206 CAR; 4 mice). Statistical differences between groups were analyzed using Kruskal-Wallis test followed by uncorrected Dunn's test (*p<0.05).

Figure 17B:
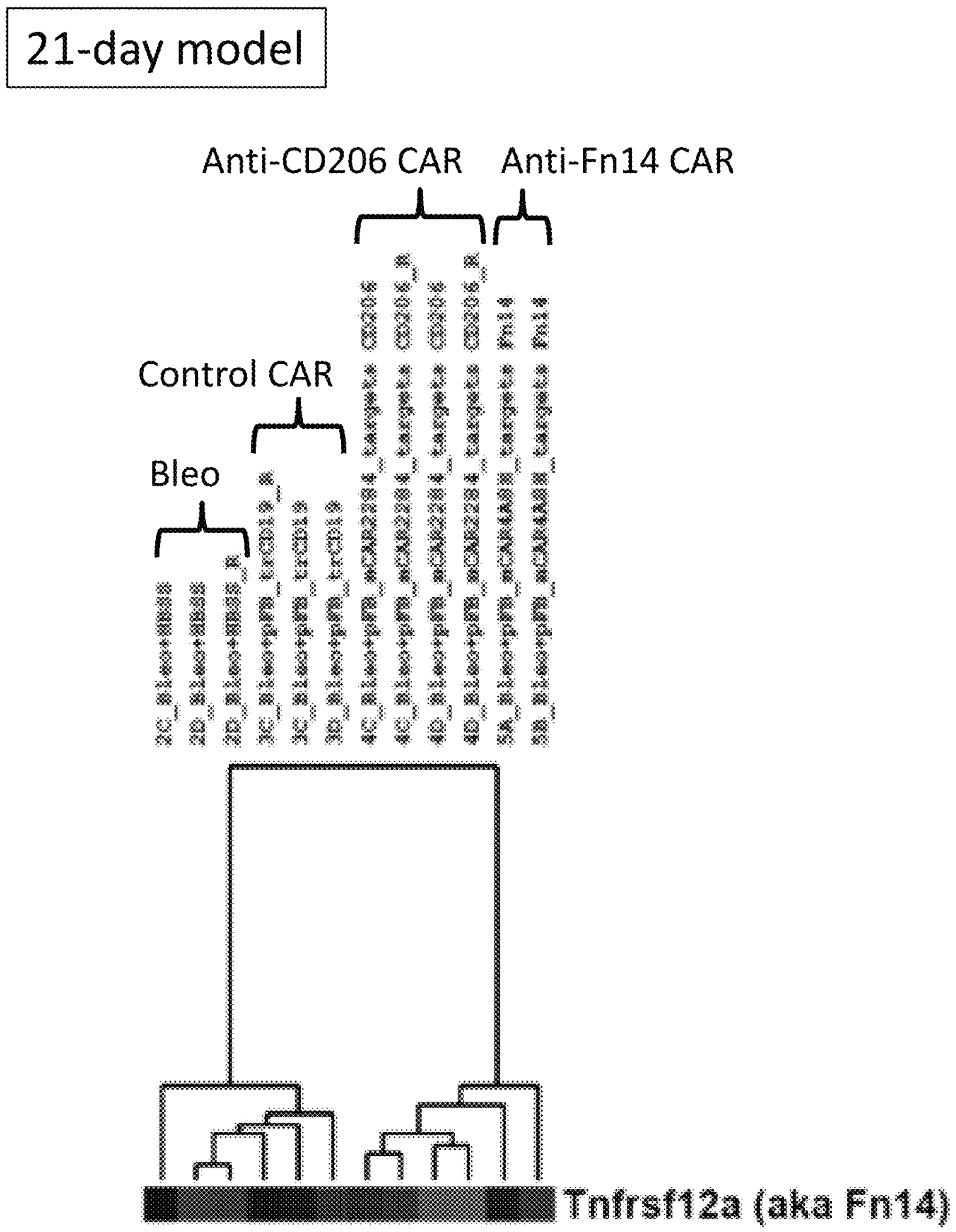

FIG. 17B shows a representative heat map comparing Fn14 RNA expression levels in the skin, analyzed by microarray using the skin sections from SSc mice (SSC induced using the 21-day bleomycin model) administered with HBSS (Bleo; 3 mice), SSc mice administered with control CAR T cells (Control CAR; 3 mice), SSc mice administered with anti-CD206 CAR T cells (Anti-CD206 CAR; 4 mice), and SSc mice administered with anti-Fn14 CAR T cells (Anti-Fn14 CAR; 2 mice).

Figure 18A:
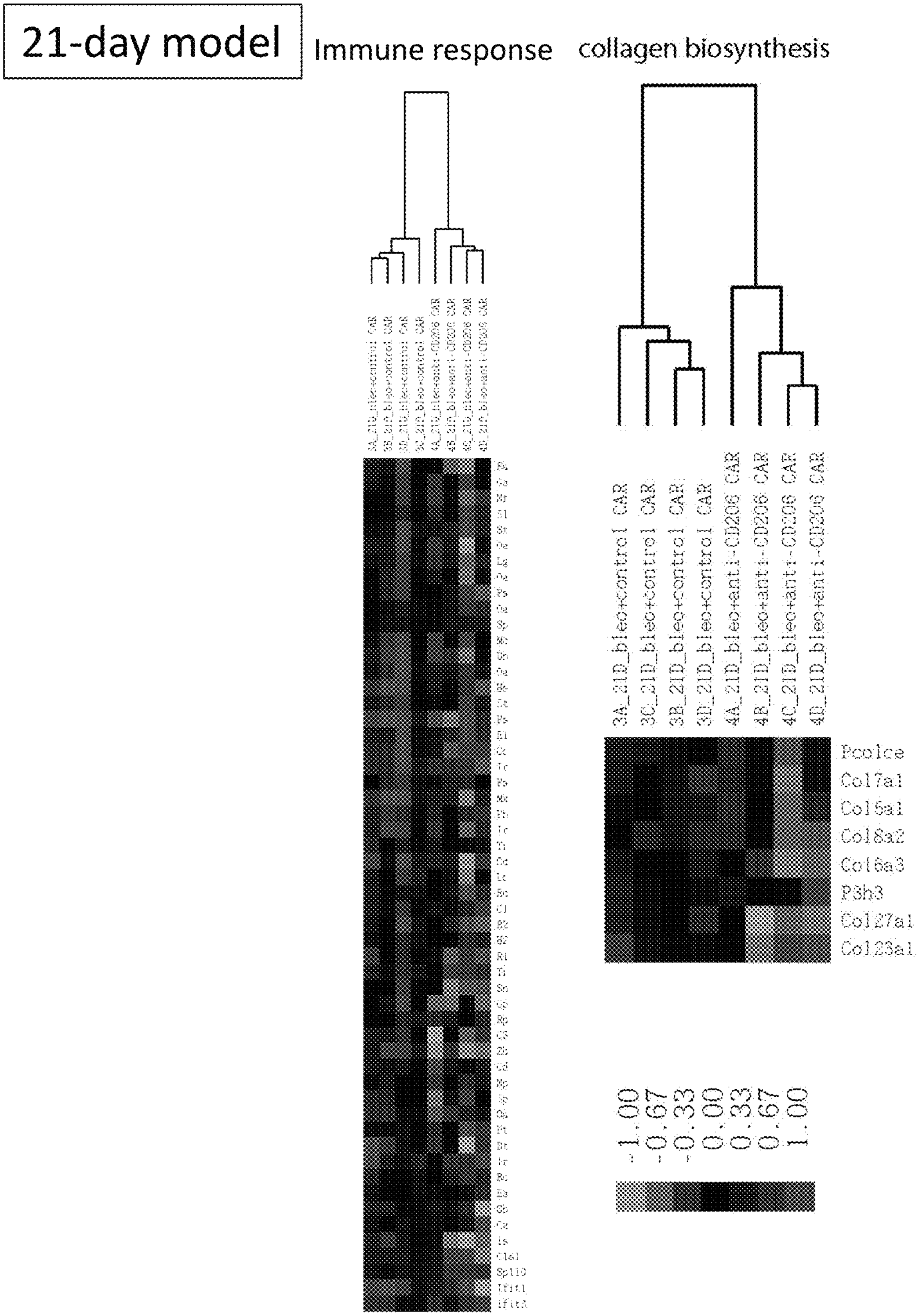

FIG. 18A shows a representative heat map comparing RNA expression levels of genes assigned to the GO term of "immune response" (left) or "collagen biosynthesis" (right) in the skin, analyzed by differential gene expression and functional enrichment analyses. The heat map compares the skin sections from SSc mice administered with control CAR T cells (bleo+control CAR; 4 mice) and SSc mice administered with anti-CD206 CAR T cells (bleo+anti-CD206 CAR; 4 mice). SSC was induced using the 21-day bleomycin model. The color bar shown in FIG. 18A also applies to all other heat maps except for the map in FIG. 19A.

Figure 18B:
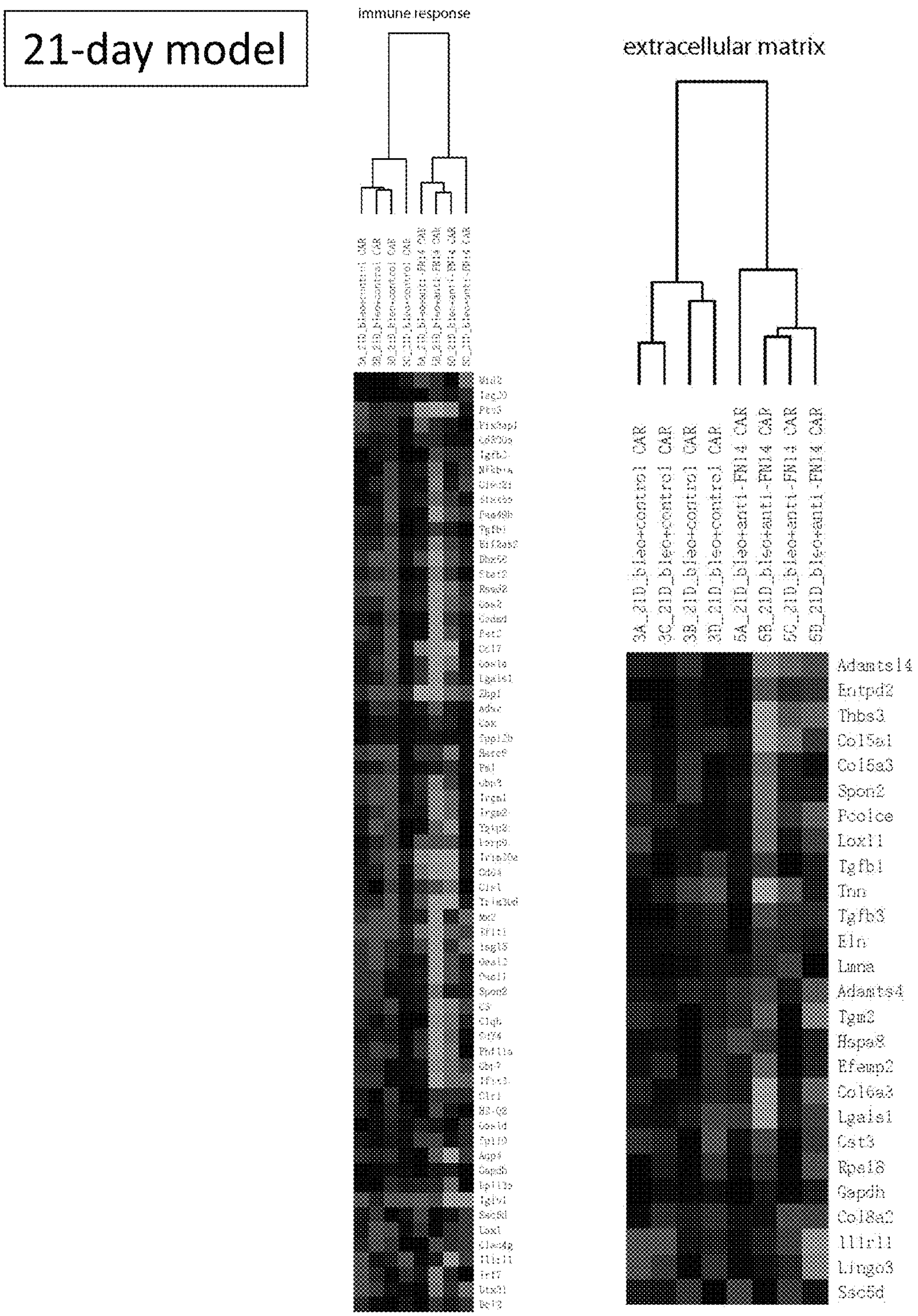

FIG. 18B shows a representative heat map comparing RNA expression levels of genes assigned to the GO term of "immune response" (left) or "extracellular matrix" (right) in the skin, analyzed by differential gene expression and functional enrichment analyses. The heat map compares the skin sections from SSc mice administered with control CAR T cells (bleo+control CAR; 4 mice) and SSc mice administered with anti-Fn14 CAR T cells (bleo+anti-Fn14 CAR; 4 mice). SSC was induced using the 21-day bleomycin model.

Figure 19A:
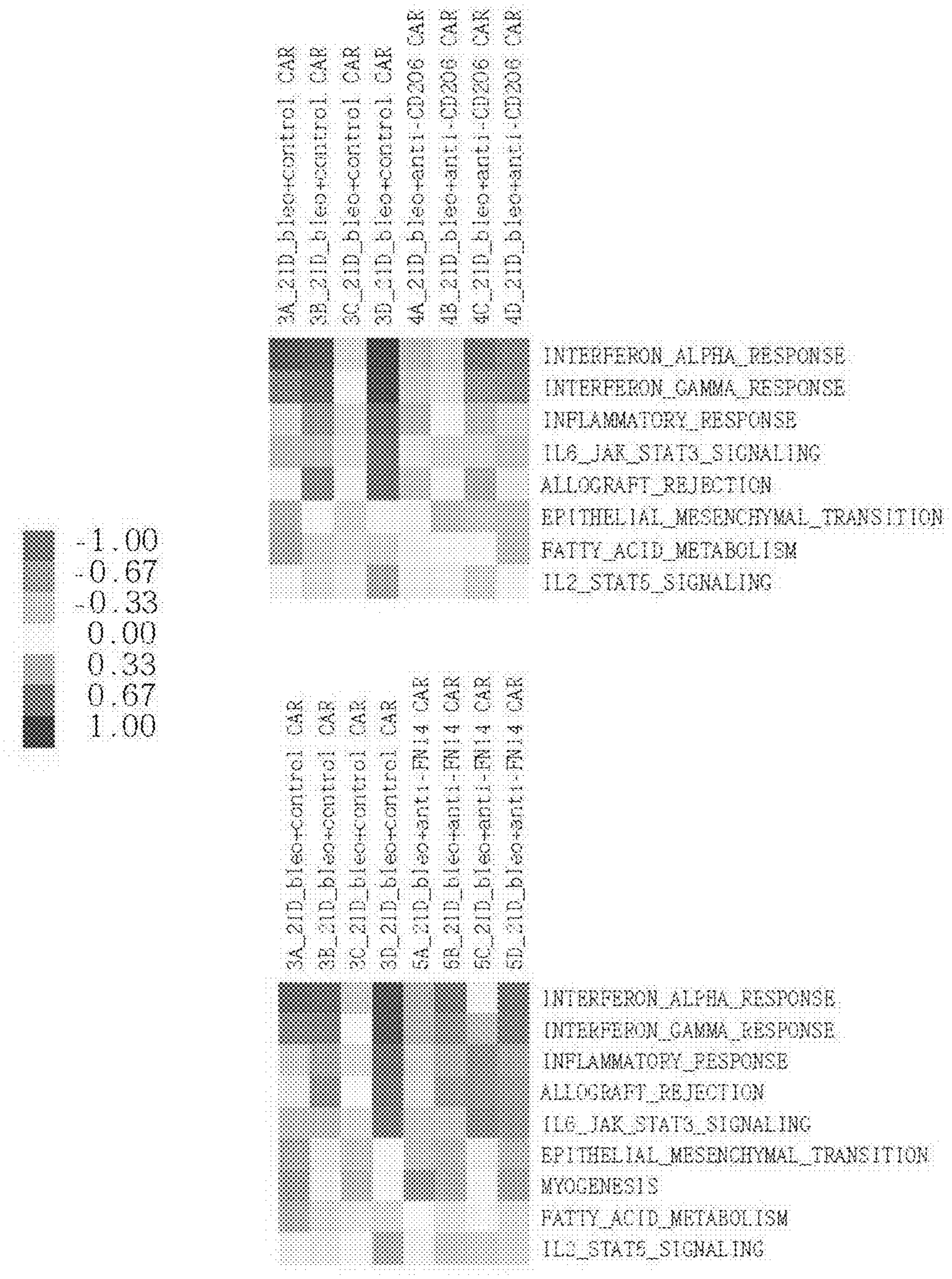

FIG. 19A shows representative heat maps showing differential expression of pathways that were downregulated by CAR treatment according to the present invention. The heat map compares the skin sections from SSc mice administered with control CAR T cells (bleo+control CAR; 4 mice) to SSc mice administered with anti-CD206 CAR T cells (bleo+anti-CD206 CAR; 4 mice) (top) or to SSc mice administered with anti-Fn14 CAR T cells (bleo+anti-Fn14 CAR; 4 mice) (bottom). SSC was induced using the 21-day bleomycin model.

Figure 19B:
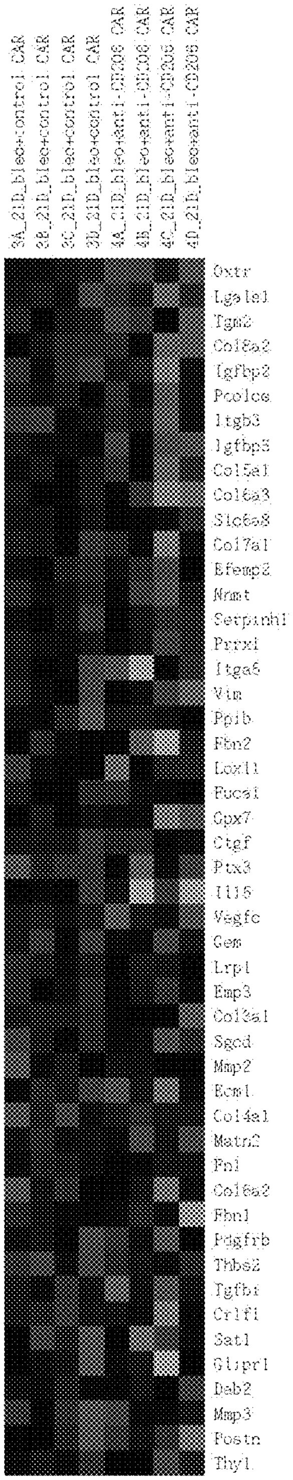

FIG. 19B shows a representative heat map comparing RNA expression levels of 49 genes assigned to the epithelial-mesenchymal transition (EMT) pathway as found by GSEA, analyzed by functional enrichment analyses. The heat map compares the skin sections from SSc mice administered with control CAR T cells (bleo+control CAR; 4 mice) and SSc mice administered with anti-CD206 CAR T cells (bleo+anti-CD206 CAR; 4 mice). SSC was induced using the 21-day bleomycin model.

DETAILED DESCRIPTION

One aspect of the present invention in general relates to the construction and use of novel chimeric antigen receptors (CARs). The CARs bind to a molecule expressed in a fibrotic setting or expressed on disease-associated macrophages (DAMs). In particular, the CAR of the present invention comprises an antigen binding (AB) domain that binds to a target molecule which is expressed on DAMs or which is over or aberrantly-expressed in fibrosis, a transmembrane (TM) domain, and one or more intracellular signaling (ICS) domains. The invention also provides polynucleotides encoding these CARs, vectors comprising polynucleotides encoding these CARs, cells expressing these CARs, pharmaceutical compositions comprising cells expressing these CARs, and methods of making and using these CARs and CAR-expressing cells. The invention also provides methods for treating a condition associated with DAMs or a fibrotic condition in a subject, such as inflammatory diseases, fibrotic diseases, or autoimmune diseases.

Another aspect of the present invention relates to the construction and use of such novel CAR-expressing cells further comprising exogenously introduced polynucleotides encoding an anti-fibrotic molecule or an anti-inflammatory molecule. The invention also provides a vector or vectors for generating such cells, pharmaceutical compositions comprising cells expressing both the CAR and the anti-fibrotic or anti-inflammatory molecule, and methods of making and using these cells expressing both the CAR and the anti-fibrotic or anti-inflammatory molecules.

CAR Target

The CAR of the present invention comprises an AB domain that binds to a target molecule which is expressed on DAMs or over- or aberrantly-expressed in fibrosis. MPs involved in disease processes, particularly in autoimmune diseases, inflammation, or fibrosis, are collectively referred to herein as DAMs. DAMs may also be called, for example, alternatively activated MPs, M2 MPs, M2-like MPs, M2a MPs, M2b MPs, M2c MPs, M4 MPs, pro-fibrotic MPs, or tumor-associated MPs (TAMs), depending on the context, function, and phenotype (Murray, P. J., and Wynn, T. A., "Protective and pathogenic functions of macrophage subsets", *Nat Rev Immunol.* 2011 Oct. 14; 11(11): p. 723-37; Chinetti-Gbaguidi, G., Colin, S., and Staels, B., "Macrophage subsets in atherosclerosis", *Nat Rev Cardiol.* 2015 January; 12(1): p. 10-7). While conventionally-activated MPs or M1 MPs produce TNF-α, IL-12, or nitric oxide, DAMs generally produce cytokines such as, but not limited to, IL-4, IL-10, IL-13, or TGF-β upon activation (Classen, A., Lloberas, J., and Celada, A., "Macrophage activation: classical versus alternative", *Methods Mol Biol.* 2009; 531: p. 29-43). When detecting or targeting DAMs, the surface molecule to target may be selected according to the MP subpopulation of interest.

Exemplary CARs of the present invention may bind to, for example, Fn14, CD163, or CD206.

Fibroblast growth factor-inducible 14 (Fn14, or FGF-inducible 14) is alternatively called TNF-related weak inducer of apoptosis receptor (TWEAK receptor, TWEAKR or TWEAK-R), TNF receptor family member 12A (TNFRSF12A), or CD266. In humans, Fn14 is encoded by the TNFRSF12A gene on chromosome 16, with gene location 16p13.3 (NCBI). Human Fn14 has an amino acid sequence provided as NCBI Reference Sequence: NP_057723.1, or the equivalent residues from a non-human species, e.g., mouse, rodent, monkey, ape, and the like. Mouse Fn14 has an amino acid sequence provided as GenBank Acc. No. AAH25860.1, or the equivalent residues from a non-mouse species, e.g., human, rodent, monkey, ape, and the like. In one aspect, human Fn14 has the sequence provided as SEQ ID NO: 103, or the equivalent residues from a non-human species, e.g., mouse, rodent, monkey, ape, and the like. In one aspect, mouse Fn14 has the sequence provided as SEQ ID NO: 703, or the equivalent residues from a non-mouse species, e.g., human, rodent, monkey, ape, and the like. Fn14 is the only known signaling receptor for the cytokine TWEAK (TNFSF12), and its expression on DAMs and the pathological role is implicated in various pathological settings such as cardiovascular diseases, autoimmune diseases, inflammation, and metabolic syndromes (Moreno J A, et al., "HMGB1 expression and secretion are increased via TWEAK-Fn14 interaction in atherosclerotic plaques and cultured monocytes", *Arterioscler Thromb Vase Biol* 2013; 33:612-620; Schapira K, et al. "Fn14-Fc fusion protein regulates atherosclerosis in ApoE38/38 mice and inhibits macrophage lipid uptake in vitro", *Arterioscler Thromb Vasc Biol* (2009) 29:2021-7; Madrigal-Matute, J., "TWEAK/Fn14 interaction promotes oxidative stress through NADPH oxidase activation in macrophages", *Cardiovasc Res.* 2015 Oct. 1; 108(1): p. 139-47; Serafini, B., "Expression of TWEAK and its receptor Fn14 in the multiple sclerosis brain: implications for inflammatory tissue injury", J *Neuropathol* Exp Neurol. 2008 December; 67(12): p. 1137-48; Van Kuijk, A. W., et al. "TWEAK and its receptor Fn14 in the synovium of patients with rheumatoid arthritis compared to psoriatic arthritis and its response to tumour necrosis factor blockade", *Ann Rheum Dis.* 2010 January; 69(1):301-4; Vendrell, J., and Chacon, M. R., "TWEAK: A new player in obesity and diabetes", *Front Immunol.* 2013 Dec. 30; 4:488). Fn14 is also expressed on non-MP cells, such as fibroblasts, epithelial cells, and tumor cells, and its pathological role also shown in many diseases including myofibrosis, asthma, COPD, and cancer (Novoyatieva, T., et al., "Deletion of Fn14 receptor protects from right heart fibrosis and dysfunction", *Basic Res Cardiol.* 2013 March; 108(2): p 325; Itoigawa, Y., et al., "TWEAK enhances TGF-β-induced epithelial-mesenchymal transition in human bronchial epithelial cells", *Respir Res.* 2015 Apr. 8; 16:48; Zhou, H., et al., "The TWEAK receptor Fn14 is a novel therapeutic target in melanoma: Immunotoxins targeting Fn14 receptor for malignant melanoma treatment", J Invest Dermatol. 2013 April; 133(4): p. 1052-62; Culp, P. A., et al., "Antibodies to TWEAK receptor inhibit human tumor growth through dual mechanisms", *Clin Cancer Res.* 2010 Jan. 15; 16(2): p. 497-508).

CD163 is also known as scavenger receptor cystein-rich type 1 protein M130 or hemoglobin scavenger receptor. In humans, CD163 is encoded by the CD163 gene on chromosome 12, with gene location 12p13.31 (NCBI). Human CD163 has an amino acid sequence provided as GenBank Ace. No. AAY99762.1, or the equivalent residues from a non-human species, e.g., mouse, rodent, monkey, ape, and the like. Mouse CD163 has an amino acid sequence provided as GenBank Ace. No. AAI44849.1, or the equivalent residues from a non-mouse species, e.g., human, rodent, monkey, ape, and the like. In one aspect, human CD163 has the sequence provided as SEQ ID NO: 102, or the equivalent residues from a non-human species, e.g., mouse, rodent, monkey, ape, and the like. In one aspect, mouse CD163 has the sequence provided as SEQ ID NO: 702, or the equivalent residues from a non-mouse species, e.g., human, rodent, monkey, ape, and the like. CD163 is expressed on alternatively activated, M2, or M2c MPs, and elevated production of CD163 by DAMs is seen in a variety of diseases including rheumatoid arthritis (RA) and SSc (Baeten, D., et al., "Association of $CD163^{+}$ macrophages and local production of soluble CD163 with decreased lymphocyte activation in spondylarthropathy synovitis", *Arthritis Rheum.* 2004 May; 50(5): p. 1611-23; Higashi-Kuwata N., et al., "Alternatively activated macrophages (M2 macrophages) in the skin of patient with localized scleroderma", *Exp Dermatol.* 2009 August; 18(8):727-9.; Higashi-Kuwata N., et al., "Characterization of monocyte/macrophage subsets in the skin and peripheral blood derived from patients with systemic sclerosis", *Arthritis Res Ther.* 2010; 12(4)).

CD206 is also known as mannose receptor (MR), macrophage mannose receptor (MMR), macrophage mannose receptor 1 (MMR1), C-type mannose receptor 1 (MRC1), or C-type lectin domain family member D (CLEC13D). In humans, CD206 is encoded by the MRC1 gene on chromosome 10, with gene location 10p12.33 (NCBI). Human CD206 has an amino acid sequence provided as NCBI Reference Sequence: NP_002429.1, or the equivalent residues from a non-human species, e.g., mouse, rodent, monkey, ape, and the like. Mouse CD206 has an amino acid sequence provided as NCBI Reference Sequence: NP_032651.2, or the equivalent residues from a non-mouse species, e.g., human, rodent, monkey, ape, and the like. In one aspect, human CD206 has the sequence provided as SEQ ID NO: 101, or the equivalent residues from a non-human species, e.g., mouse, rodent, monkey, ape, and the like. In one aspect, mouse CD206 has the sequence provided as SEQ ID NO: 701, or the equivalent residues from a non-mouse species, e.g., human, rodent, monkey, ape, and the like. CD206 is a C-type lectin primarily present on MPs, often found on M2, M2a, M2b, or M2c MPs, and overexpression of CD206 on DAMs is confirmed in many diseases including cancers (Luo, Y., et al., "Targeting tumor-associated macrophages as a novel strategy against beast cancer", *J Clin Invest.* 2006 August; 116(8): p. 2132-2141), and in SSc CD206 expression is directly correlated with disease severity and mortality (Christmann, R. B., et al., "Interferon and alternative activation of monocyte/macrophages in systemic sclerosis-associated pulmonary arterial hypertension", *Arthritis Rheum,* 2011. 63(6): p. 1718-28).

The examples below describe CARs comprising an AB domain which binds to a target molecule expressed on DAMs or over- or aberrantly-expressed in fibrosis and can be used for treating diseases associated with fibrotic or inflammatory conditions or DAMs. Examples of such diseases include fibrotic diseases, chronic infection, some autoimmune diseases, allergic disorders, cardiovascular diseases, metabolic diseases, and malignant diseases. More specific disease examples include SSc, idiopathic pulmonary fibrosis, cystic fibrosis, ulcerative colitis, myelofibrosis, asthma, COPD, multiple sclerosis (MS), atherosclerosis, obesities, diabetes, and cancer.

The CAR target may be selected from various DAM- or fibrosis-associated molecules. Exemplary DAM-associated molecules that may be targeted include fibroblast growth factor-inducible 14 (Fn14), CD163, CD206, CD209, FIZZ2 CD11b, SR1, CD68, CD115, MAC2, MARCO, CD11c, CD16, CD14, CD64, CD32, CD36, CD169, CD204, IL-4R α, IL-13RA1, EDNRA, EDNRB, IL6R, PDGFRB, HMGCR, PDGFRA, KDR, FLT1, HLA-DQB1, FGFR3, FGFR1, FLT4, FGFR2, FGFR4, TGFBRI, TGFBRII, IRF8, CD247, TNIP1, ITGAM, SOX5, ZC3H10, TNFAIP3, BLK, ANKS1A, PTGIR, KIT, ABL1, GRB10, C15orf39, TNFSF4, LAMC2, IKZF3, IL13, TNFSF13B, MS4A1, SCN4A, SCN2A, SCN8A, SCN11A, SCN7A, SCN3A, SCN10A, SCN5A, SCN9A, SCN1A, RHOB, FKBP1A, SRC, CD19, CTGF, CD109, VDR, DKK1, IL6, SERPINH1, NR3C1, TGFB1, EPHA2, SRMS, DHFR, HCK, YES1, ALDH5A1, LYN, FRK, LCK, or FGR. See targetvalidation.org Exemplary fibrosis-associated molecules, with observed aberrant expression in sarcoidosis idiopathic pulmonary fibrosis, pulmonary fibrosis associated with systemic sclerosis, and systemic sclerosis in general include: ceruloplasmin, α1-B-glycoprotein, complement C3β, monomeric or dimeric α1-antitrypsin, α1-antichymotrypsin, haptoglobin β, complement factor B, α1-antiplasmin haptoglobin β (cl), complement C3, complement factor I, apolipoprotein A1, β-2-microglobulin, prothrombin, amyloid P, calcyphosine, thioredoxin, AOPP, calgranulin A, α-2-macroglobulin, cyclophilin A, calgranulin B, TCTP, cytidylate kinase, L-FABP, thioredoxin peroxidase 2, MIF, galectin 1, ubiquitin, SRBP, transthyretin, psoriasin, cystatin B, glyceraldehyde-3 P dehydrogenase, triose phosphate isomerase, and actin-related protein 2/3 complex subunit 2. See Rottoli et al., *Proteomics* 2005; 5:1423-30 and Giusti et al., *J Rheumatol* 2007; 34:2063-9. Other fibrosis-associated molecules may also be targeted, e.g., those implicated in nephrolithiasis, including AMBP protein, α-1-antitrypsin, uromodulin, hemopexin, S100A8, α-2-glycoprotein 1, α-1-acid glycoprotein, prostaglandin-H2 D-isomerase, serotransferrin, haptoglobin, haptoglobin-related proteins, neutrophil gelatinase-associated lipocalin, lysozyme C, α-2 macroglobulin, retinol-binding protein 4, and S100A9. See Boonla et al., *Clinica Chimica Acta* 2014; 429:81-9.

Fn14, CD206, and CD163 are particularly associated with MP types involved in inflammatory or fibrotic diseases processes, or alternatively activated MPs, M2 MPs, M2-like MPs, M2a MPs, M2b MPs, M2c MPs, M4 MPs, pro-fibrotic MPs, or tumor-associated MPs (TAMs), but not typically with conventionally activated MPs or M1 MPs. Therefore Fn14, CD206, or CD163 would be particularly a good target molecule when aiming for eliminating DAMs MPs, minimizing off target effects. To the best of applicant's knowledge, CARs against Fn14, CD206, or CD163 have never been generated.

Since Fn14 is also expressed on other disease-associated cells such as fibroblasts and epithelial cells in the fibrotic context, the use of anti-Fn14 CAR cell would have an additional benefit of being able to eliminate not just DAMs but also those non-DAM pathological cells in treating fibrotic conditions.

Antigen Binding (AB) Domain

The present invention provides a CAR comprising an AB domain, a TM domain, and one or more ICS domains. A general schematic of CARs of the present invention is shown in FIG. 1. The AB domain comprises a target-specific binding element that binds to a molecule which is expressed on DAMs or which is over- or aberrantly-expressed in fibrosis. Such a molecule is referred to as target molecule herein, and the exemplary target molecules include Fn14, CD163, and CD206.

The AB domain may be derived from a polypeptide that binds to the target molecule. In some embodiments, the polypeptide may be a receptor or a portion of a receptor that binds to the target molecule. In another embodiment, the AB domain may be derived from a ligand that binds to the target molecule.

In another embodiment, the AB domain may be derived from an antibody (Ab) or antigen-binding fragment thereof that binds to the target molecule. Examples of an Ab or antigen-binding fragment thereof include, but are not limited to, a monoclonal Ab, a monospecific Ab, a polyspecific Ab, a humanized Ab, a tetrameric Ab, a tetravalent Ab, a multispecific Ab, a single chain Ab, a domain-specific Ab, a single-domain Ab (dAb), a domain-deleted Ab, an scFc fusion protein, a chimeric Ab, a synthetic Ab, a recombinant Ab, a hybrid Ab, a mutated Ab, CDR-grafted Ab, an Ab fragment comprising a fragment antigen-binding (Fab), an $F(ab')_2$, an Fab' fragment, an variable fragment (Fv), a single-chain antibody fragment, a single-chain Fv (scFv) fragment, an Fd fragment, a dAb fragment, a diabody, a nanobody, a bivalent nanobody, a shark variable IgNAR domain, a VHH Ab, a camelid Ab, and a minibody. In a particular embodiment, the AB domain comprises a single-chain antibody fragments comprising a variable heavy chain region and/or a variable light chain region, such as scFv. In another particular embodiment, the AB domain comprises a nanobody.

Single-domain Abs are Ab fragments comprising all or a portion of the heavy chain variable domain or all or a portion of the light chain variable domain of an antibody. In certain embodiments, a single-domain antibody is a human single-domain antibody.

Antibody fragments can be made by various techniques, including but not limited to proteolytic digestion of an intact Ab as well as production by recombinant host cells. In some embodiments, the antibodies are recombinantly produced fragments, such as fragments comprising arrangements that do not naturally occur, such as those with two or more Ab regions or chains joined by synthetic linkers, such as peptide linkers, and/or that may not be produced by enzyme digestion of a naturally occurring intact Ab. In some aspects, the Ab fragments are scFvs. In some aspects, the Ab fragments are nanobodies.

In some aspects, the AB domain may be derived from an Ab or an antigen-binding fragment thereof that has one or more specified functional features, such as binding properties, including binding to particular epitopes, such as epitopes that are similar to or overlap with those of other Abs.

In a preferred embodiment, the AB domain binds to Fn14. In certain aspects, the AB binds to human or mouse Fn14. Human Fn14 may have an amino acid sequence such as the sequence set forth in SEQ ID NO: 103.

In another aspect, the AB domain may compete for binding to Fn14 with, or may bind to the same or an overlapping epitope of, the anti-Fn14 scFv derived from an anti-Fn14 antibody P4A8 or P3G5 (see U.S. patent application Ser. No. 12/463,291, Publication No. US20090324602A1). As disclosed in the two patent documents, the Abs (P4A8 and P3G5) are able to bind to both mouse and human Fn14. In yet another aspect, the AB domain binds to the same epitope as the anti-Fn14 scFv Ab P4A8 or P3G5. In a further aspect, the AB domain may contain the same CDR(s) as the CDRs present in Ab P4A8 or P3G5.

In yet another aspect, the AB domain may be derived from, TWEAK (TNF-related weak inducer of apoptosis), a ligand of Fn14. TWEAK is also called TNF superfamily member 12 (TNFSF12), APO3L, DR3LG, or TNLG4A. In humans, TWEAK is encoded by the TNFSF12A gene on chromosome 17, with gene location 17p13.1 (NCBI). Human TWEAK has an amino acid sequence provided as Genbank Ace. No. AAC51923.1, or the equivalent residues from a non-human species, e.g., mouse, rodent, monkey, ape, and the like. In mice, TWEAK is encoded by the Tnfsf12 gene on chromosome 11, with gene location 11; 11 B3 (NCBI). Mouse TWEAK has an amino acid sequence provided as GenBank Ace. No. AAC53517.2, or the equivalent residues from a non-mouse species, e.g., human, rodent, monkey, ape, and the like. Particularly, in some aspects, the AB domain may contain the amino acid sequence corresponding to the portion within TWEAK that binds to Fn14.

In yet another preferred embodiment, the AB domain binds to CD206. In certain aspects, the AB binds to human or mouse CD206. Human CD206 may have an amino acid sequence such as the sequence as set forth in SEQ ID NO: 101. In another aspect, the AB domain may compete for binding to CD206 with, or may bind to the same or an overlapping epitope of, the anti-CD206 nanobody NbMMRm22.84 or NbMMRm5.38 (see U.S. Pat. No. 9,617,339). As disclosed in the patent documents, the nanobodies (NbMMRm22.84 and NbMMRm5.38) are able to bind to both mouse and human CD206. In yet another aspect, the AB domain binds to the same epitope as the anti-CD206 nanobody NbMMRm22.84 or NbMMRm5.38. In a further aspect, the AB domain may contain the same CDR(s) as the CDRs present in the nanobody NbMMRm22.84 or NbMMRm5.38.

In some embodiments, the extent of binding of the AB domain to an unrelated non-target molecule is less than about 40% of the binding of the AB domain to the target molecule. In some embodiments, the extent of binding of the AB domain to an unrelated non-target molecule is less than or about 30%, less than or about 20%, or less than or about 10% of the binding of the AB domain to the target molecule.

In some embodiments, the AB domain is derived from an Ab or antigen-binding fragment thereof with heavy and light chain CDRs that are distinct from the CDRs present in anti-Fn14 Ab P4A, anti-Fn14 P3G5, anti-CD206 nanobody NbMMRm22.84, and anti-CD206 nanobody NbMMRm5.38. For example, an Abs or antigen-binding fragment thereof that competes for binding to the target molecule with the anti-Fn14 Ab P4A8, anti-Fn14 Ab P3G5, anti-CD206 nanobody NbMMRm22.84, or anti-CD206 nanobody NbMMRm5.38 may still contain distinct CDRs from the CDRs of the anti-Fn14 Ab P4A8, anti-Fn14 Ab P3G5, anti-CD206 nanobody NbMMRm22.84, or anti-CD206 nanobody NbMMRm5.38, respectively.

In some embodiments the AB domain, the CARs comprising such, and the cells comprising such CARs display a binding preference for cells expressing the target molecule as compared to cells not expressing the target molecule. In some embodiments, a significantly greater degree of binding is observed to the cells expressing the target molecule as compared to cells not expressing the target molecule. In some cases, the total degree of binding of the AB domain to the target molecule or to cells expressing the target molecule is approximately the same, at least as great, or greater than the binding of domains, CARs, or cells not specific to the target molecule. In any of the provided embodiments, comparison of binding properties, such as affinities or competition, may be via measurement by the same or similar assay.

In some embodiments, the AB comprises an scFv comprising CDR sequences of an Ab specific to the target molecule CDRs may be determined using conventional methods. The precise amino acid sequence boundaries of a given CDR or FR can be readily determined using any of a number of well-known schemes, including those described by Kabat et al. (1991), "Sequences of Proteins of Immunological Interest," 5$^{th}$ Ed. Public Health Service, National Institutes of Health, Bethesda, Md. ("Kabat" numbering scheme), Al-Lazikani et al., "(1997) *J. Mol. Bol.* 273, 927-948 ("Chothia" numbering scheme), MacCallum et al., *J. Mol. Biol.* 262:732-745 (1996), "Antibody-antigen interactions: Contact analysis and binding site topography," J. Mol. Biol. 262, 732-745 ("Contact" numbering scheme), Lefranc M P et al., "IMGT unique numbering for immunoglobulin and T cell receptor variable domains and Ig superfamily V-like domains," *Dev Comp Immunol,* 2003 January; 27(1):55-77 ("IMGT" numbering scheme), and Honegger A and Pluckthun A, "Yet another numbering scheme for immunoglobulin variable domains: an automatic modeling and analysis tool," *J Mol Biol,* 2001 Jun. 8; 309(3):657-70, ("Aho" numbering scheme).

In an embodiment, the sequence comprising the AB domain further comprises a leader sequence or signal sequence. In embodiments where the AB domain comprises an scFv, the leader sequence may be positioned at the amino terminus of the scFv. In some embodiments where the heavy chain variable region is N-terminal, the leader sequence may be positioned at the amino terminus of the heavy chain variable region. In some embodiments where the light chain variable region is N-terminal, the leader sequence may be positioned at the amino terminus of the light chain variable region. The leader sequence may comprise any suitable leader sequence. In some embodiments of the invention, the amino acid sequence of the leader sequence may comprise a sequence as set forth in SEQ ID NO: 105, or a sequence encoded by the nucleic acid sequence as set forth in SEQ ID NO: 205. In the mature form of the isolated cells of the invention, the leader sequence may not be present.

In a preferred embodiment, when the target molecule is Fn14, the AB domain comprises an scFv comprising the CDR sequences of anti-Fn14 Ab P4A8, or anti-Fn14 Ab P3G5. In another preferred embodiment, when the target molecule is CD206, the AB domain comprises a nanobody comprising the CDR sequences of anti-CD206 nanobody NbMMRm22.84, or anti-CD206 nanobody NbMMRm5.38.

Preferably, when the target molecule is Fn14, the AB domain of the CAR is an anti-Fn14 scFv. In a preferred embodiment, the anti-Fn14 scFv contains the CDRs of the anti-Fn14 Ab P4A8 or anti-Fn14 Ab P3G5 (see SEQ ID NOs: 119-121, 123-125, 127-129, and 131-133). In a preferred embodiment, the anti-Fn14 scFv contains the variable heavy (VH) chain of the anti-Fn14 Ab P4A8 or anti-Fn14 Ab P3G5 (SEQ ID NO: 118 or 126, encoded by SEQ ID NO: 218 or 226) and the variable light ($V_L$) chain of the anti-Fn14 Ab P4A or anti-Fn14 Ab P3G5 (SEQ ID NO: 122 or 130, encoded by SEQ ID NO: 222 or 230).

In such embodiments, the $V_H$ chain and $V_L$ chain be optionally linked via a linker. The linker may be the G4S X3 linker, comprising amino acid sequence set forth in SEQ ID NO: 140 or the sequence encoded by SEQ ID NO: 240.

The $V_H$ chain of the scFv may be positioned at the N-terminus of the CAR or closer to the N-terminus of the CAR relative to the VL chain. In such cases, the anti-Fn14 scFv may comprise the anti-Fn14 scFv P4A8 HL or anti-Fn14 scFv P3G5 HL, comprising the amino acid sequence as set forth in SEQ ID NO: 141 or 143, or the sequence encoded by SEQ ID NO: 241 or 243, respectively.

Alternatively, the $V_L$ chain of the scFv may be positioned at the N-terminus of the CAR or closer to the N-terminus of the CAR relative to the VH chain. In such cases, the anti-Fn14 scFv may comprise the anti-Fn14 scFv P4A8 LH or anti-Fn14 scFv P3G5 LH, comprising the amino acid sequence as set forth in SEQ ID NO: 142 or 144, or the sequence encoded by SEQ ID NO: 242 or 244, respectively.

Preferably, when the target molecule is CD206, the AB domain of the CAR is an anti-CD206 nanobody. In a preferred embodiment, the anti-CD206 nanobody contains the CDRs of the anti-CD206 nanobody NbMMRm22.84 or anti-CD206 nanobody NbMMRm5.38 (see SEQ ID NOs: 111-113 and 115-117). In a preferred embodiment, the anti-CD206 nanobody may comprise the anti-CD206 nanobody NbMMRm22.84 or anti-CD206 nanobody NbMMRm5.38, comprising the amino acid sequence as set forth in SEQ ID NO: 110 or 114, or the sequence encoded by SEQ ID NO: 210 or 214, respectively.

A schematic showing various exemplary AB domain constructs of CARs of some embodiments are illustrated in FIG. 5.

Hinge

In some embodiments, the CAR comprises a hinge sequence between the AB domain and the TM domain. One of the ordinary skill in the art will appreciate that a hinge sequence is a short sequence of amino acids that facilitates flexibility (see, e.g. Woof et al., *Nat. Rev. Immunol.,* 4(2): 89-99 (2004)). The hinge sequence can be any suitable sequence derived or obtained from any suitable molecule. In some embodiments, the length of the hinge sequence may be optimized based on the desired length of the extracellular portion of the CAR, which may be based on the location of the epitope within the target molecule. For example, if the epitope is in the membrane proximal region within the target molecule, longer hinges may be optimal.

In some embodiments, the hinge may be derived from or include at least a portion of an immunoglobulin Fc region, for example, an IgG1 Fc region, an IgG2 Fc region, an IgG3 Fc region, an IgG4 Fc region, an IgE Fc region, an IgM Fc region, or an IgA Fc region. In certain embodiments, the hinge includes at least a portion of an IgG1, an IgG2, an IgG3, an IgG4, an IgE, an IgM, or an IgA immunoglobulin Fc region that falls within its CH2 and CH3 domains. In some embodiments, the hinge may also include at least a portion of a corresponding immunoglobulin hinge region. In some embodiments, the hinge is derived from or includes at least a portion of a modified immunoglobulin Fc region, for example, a modified IgG1 Fc region, a modified IgG2 Fc region, a modified IgG3 Fc region, a modified IgG4 Fc region, a modified IgE Fc region, a modified IgM Fc region, or a modified IgA Fc region. The modified immunoglobulin Fc region may have one or more mutations (e.g., point mutations, insertions, deletions, duplications) resulting in one or more amino acid substitutions, modifications, or deletions that cause impaired binding of the hinge to an Fc receptor (FcR). In some aspects, the modified immunoglobulin Fc region may be designed with one or more mutations which result in one ore more amino acid substitutions, modifications, or deletions that cause impaired binding of the hinge to one or more FcR including, but not limited to, FcγR1, FcγR2A, FcγR2B1, Fcγ2B2, Fcγ 3A, Fcγ 3B, FcεR, FcεR2, FcαRI, Fcα/μR, or FcRn.

In some aspects, a portion of the immunoglobulin constant region serves as a hinge between the AB domain, for example scFv or nanobody, and the TM domain. The hinge can be of a length that provides for increased responsiveness of the CAR-expressing cell following antigen binding, as compared to in the absence of the hinge. In some examples, the hinge is at or about 12 amino acids in length or is no more than 12 amino acids in length. Exemplary hinges include those having at least about 10 to 229 amino acids, about 10 to 200 amino acids, about 10 to 175 amino acids, about 10 to 150 amino acids, about 10 to 125 amino acids, about 10 to 100 amino acids, about 10 to 75 amino acids, about 10 to 50 amino acids, about 10 to 40 amino acids, about 10 to 30 amino acids, about 10 to 20 amino acids, or about 10 to 15 amino acids, and including any integer between the endpoints of any of the listed ranges. In some embodiments, a hinge has about 12 amino acids or less, about 119 amino acids or less, or about 229 amino acids or less. Exemplary hinges include a CD28 hinge, IgG4 hinge alone, IgG4 hinge linked to CH2 and CH3 domains, or IgG4 hinge linked to the CH3 domain. Exemplary hinges include, but are not limited to, those described in Hudecek et al. (2013) *Clin. Cancer Res.,* 19:3153, international patent application publication number WO2014031687, U.S. Pat. No. 8,822,647 or published App. No. US2014/0271635.

In some embodiments, the hinge sequence is derived from CD8 α molecule or a CD28 molecule. In a preferred embodiment, the hinge sequence is derived from CD28. In one embodiment, the hinge comprises the amino acid sequence of human CD28 hinge (SEQ ID NO: 145) or the sequence encoded by SEQ ID NO: 245. In some embodiments, the hinge has an amino acid sequence at least 85%, 86%, 87%, 88%, 89%, 90%, 91%, 92%, 93%, 94%, 95%, 96%, 97%, 98%, 99%, or 100% identical to SEQ ID NO: 145. In another embodiment, the hinge comprises the amino acid sequence of mouse CD28 hinge (SEQ ID NO: 745) or the sequence encoded by SEQ ID NO: 845. In some embodiments, the hinge has an amino acid sequence at least 85%, 86%, 87%, 88%, 89%, 90%, 91%, 92%, 93%, 94%, 95%, 96%, 97%, 98%, 99%, or 100% identical to SEQ ID NO: 745.

Transmembrane (TM) Domain

With respect to the TM domain, the CAR can be designed to comprise a TM domain that is fused to the AB domain of the CAR. A hinge sequence may be inserted between the AB domain and the TM domain. In one embodiment, the TM domain that naturally is associated with one of the domains in the CAR is used. In some instances, the TM domain can be selected or modified by amino acid substitution to avoid binding of such domains to the transmembrane domains of the same or different surface membrane proteins to minimize interactions with other members of the receptor complex.

The TM domain may be derived either from a natural or from a synthetic source. Where the source is natural, the domain may be derived from any membrane-bound or transmembrane protein. Typically, the TM domain denotes a single transmembrane α helix of a transmembrane protein, also known as an integral protein. TM domains of particular use in this invention may be derived from (i.e. comprise at least the transmembrane region(s) of) CD28, CD3 ε, CD4, CD5, CD8, CD9, CD6, CD22, CD33, CD37, CD45, CD64, CD80, CD86, CD134, CD137, CD154, TCR α, TCR β, or CD3 zeta and/or TM domains containing functional variants thereof such as those retaining a substantial portion of the structural, e.g., transmembrane, properties thereof.

Alternatively the TM domain may be synthetic, in which case the TM domain will comprise predominantly hydrophobic residues such as leucine and valine. Preferably a triplet of phenylalanine, tryptophan and valine will be found at each end of a synthetic TM domain. A TM domain of the invention is thermodynamically stable in a membrane. It may be a single a helix, a transmembrane β barrel, a β-helix of gramicidin A, or any other structure. Transmembrane helices are usually about 20 amino acids in length.

Preferably, the TM domain in the CAR of the invention is derived from the TM region of CD28. In one embodiment, the TM domain comprises the amino acid sequence of human CD28 TM (SEQ ID NO: 146) or the sequence encoded by SEQ ID NO: 246. In some embodiments, the TM domain comprises an amino acid sequence at least 85%, 86%, 87%, 88%, 89%, 90%, 91%, 92%, 93%, 94%, 95%, 96%, 97%, 98%, 99%, or 100% identical to SEQ ID NO: 146. In one embodiment, the TM domain comprises the amino acid sequence of mouse CD28 TM (SEQ ID NO: 746) or the sequence encoded by SEQ ID NO: 846. In some embodiments, the TM domain comprises an amino acid sequence at least 85%, 86%, 87%, 88%, 89%, 90%, 91%, 92%, 93%, 94%, 95%, 96%, 97%, 98%, 99%, or 100% identical to SEQ ID NO: 746.

Optionally, a short oligo- or polypeptide spacer, preferably between 2 and 10 amino acids in length may form the linkage between the TM domain and the ICS domain(s) of the CAR. A glycine-serine doublet may provide a suitable spacer.

Intracellular Signaling (ICS) Domain and Costimulatory (CS) Domain

The ICS domain or otherwise the cytoplasmic domain of the CAR of the invention triggers or elicits activation of at least one of the normal effector functions of the cell in which the CAR has been placed. The term "effector function" refers to a specialized function of a cell. Effector function of a T cell, for example, may be cytolytic activity or helper activity including the secretion of cytokines. Thus, the term "intracellular signaling domain" or "ICS domain" refers to the portion of a protein which transduces the effector function signal and directs the cell to perform a specialized function. While usually the entire ICS domain can be employed, in many cases it is not necessary to use the entire chain. To the extent that a truncated portion of the intracellular signaling domain is used, such truncated portion may be used in place of the intact chain as long as it transduces the effector function signal. The term "intracellular signaling domain" or "ICS domain" is thus meant to include any truncated portion of the ICS domain sufficient to transduce the effector function signal.

Preferred examples of ICS domains for use in the CAR of the invention include the cytoplasmic sequences of the T cell receptor (TCR) and co-receptors that act in concert to initiate signal transduction following antigen receptor engagement, as well as any derivative or variant of these sequences and any synthetic sequence that has the same functional capability.

Signals generated through one ICS domain alone may be insufficient for fall activation of a cell, and a secondary or costimulatory signal may also be required. In such cases, a costimulatory domain (CS domain) may be included in the cytoplasmic portion of a CAR. A CS domain is a domain that transduces such a secondary or costimulatory signal. Optionally, the CAR of the present invention may comprise two or more CS domains. The CS domain(s) may be placed upstream of the ICS domain or downstream of the ICS domain. Two general exemplary schematics of general CAR constructs of the present invention containing at least one CS domain are illustrated in FIG. 2.

For example, T cell activation can be said to be mediated by two distinct classes of cytoplasmic signaling sequence: those that initiate antigen-dependent primary activation through the TCR (primary cytoplasmic signaling sequences) and those that act in an antigen-independent manner to provide a secondary or costimulatory signal (secondary cytoplasmic signaling sequences). Primary cytoplasmic signaling sequences regulate primary activation of the TCR complex either in a stimulatory way, or in an inhibitory way. Primary cytoplasmic signaling sequences that act in a stimulatory manner may contain signaling motifs which are known as immunoreceptor tyrosine-based activation motifs or ITAMs. Such a cytoplasmic signaling sequence may be contained in the ICS or the CS domain of the CAR of the present invention.

Examples of ITAM-containing primary cytoplasmic signaling sequences that are of particular use in the invention include those derived from an ICS domain of a lymphocyte receptor chain, a TCR/CD3 complex protein, an Fc receptor subunit, an IL-2 receptor subunit, CD3 ζ, FcR γ, FcR β, CD3 γ, CD3 δ, CD3 ε, CD5, CD22, CD66d, CD79a, CD79b, CD278 (ICOS), Fc εs RI, DAP10, and DAP12.

It is particularly preferred that the ICS domain in the CAR of the invention comprises a cytoplasmic signaling sequence derived from CD3 zeta. In one embodiment, the ICS domain comprises the amino acid sequence of human CD3 ζ ICS (SEQ ID NO: 147), or the sequence encoded by SEQ ID NO: 247. In some embodiments, the ICS domain comprises an amino acid sequence at least 85%, 86%, 87%, 88%, 89%, 90%, 91%, 92%, 93%, 94%, 95%, 96%, 97%, 98%, 99%, or 100% identical to SEQ ID NO: 147. In one embodiment, the ICS domain comprises the amino acid sequence of mouse CD3 ζ ICS (SEQ ID NO: 747), or the sequence encoded by SEQ ID NO: 847. In some embodiments, the ICS domain comprises an amino acid sequence at least 85%, 86%, 87%, 88%, 89%, 90%, 91%, 92%, 93%, 94%, 95%, 96%, 97%, 98%, 99%, or 100% identical to SEQ ID NO: 747.

In a preferred embodiment, the cytoplasmic domain of the CAR may be designed to comprise the CD3 ζ ICS domain by itself. In another preferred embodiment, the CD3 ζ ICS domain may be combined with one or more of any other desired cytoplasmic domain(s) useful in the context of the CAR of the invention. For example, the cytoplasmic domain of the CAR can comprise a CD3 ζ ICS domain and a CS domain. The CS region refers to a portion of the CAR comprising the intracellular domain of a costimulatory molecule. A costimulatory molecule is a cell surface molecule other than an antigen receptor or their ligands that is required for an efficient response of lymphocytes to an antigen.

Various CS domains have been reported to confer differing properties. For example, the 4-1BB CS domain showed enhanced persistence in in vivo xenograph models (Milone et al. *Mol Ther* 2009; 17:1453-1464; Song et al. *Cancer Res* 2011; 71:4617-4627) whereas CARs that associate with DAP10 are associated with a decreased persistence in vivo (Barber et al. *Gene Ther* 2011; 18:509-516). Additionally, these different CS domains produce different cytokine profiles, which in turn, may produce effects on target cell-mediated cytotoxicity and the disease microenvironment. Indeed, DAP10 signaling in NK cells has been associated with an increase in Th1 and inhibition of Th2 type cytokine production in $CD8^+$ T cells (Barber et al. *Blood* 2011; 117:6571-6581).

Examples of co-stimulatory molecules include an MHC class I molecule, TNF receptor proteins, Immunoglobulin-like proteins, cytokine receptors, integrins, signaling lymphocytic activation molecules (SLAM proteins), activating NK cells receptors, a Toll ligand receptor, B7-H3, BAFFR, BTLA, BLAME (SLAMF8), CD2, CD4, CD5, CD7, CD8 α, CD8 β, CD11a, LFA-1 (CD11a/CD18), CD11b, CD11c, CD11d, CD18, CD19, CD19a, CD27, CD28, CD29, CD30, CD40, CD49a, CD49D, CD49f, CD69, CD84, CD96 (Tactile), CD100 (SEMA4D), CD103, CRTAM, OX40 (CD134), 4-1BB (CD137), SLAM (SLAMF1, CD150, IPO-3), CD160 (BY55), SELPLG (CD162), DNAM1 (CD226), Ly9 (CD229), SLAMF4 (CD244, 2B4), ICOS (CD278), CEACAM1, CDS, CRTAM, DAP10, GADS, GITR, HVEM (LIGHTR), IA4, ICAM-1, IL2R β, IL2R γ, IL7R α, ITGA4, ITGA6, ITGAD, ITGAE, ITGAL, ITGAM, ITGAX, ITGB1, ITGB2, ITGB7, KIRDS2, LAT, LFA-1, LIGHT, LTBR, NKG2C, NKG2D, NKp30, NKp44, NKp46, NKp80 (KLRF1), PAG/Cbp, PD-1, PSGL1, SLAMF6 (NTB-A, Ly108), SLAMF7, SLP-76, TNFR2, TRANCE/RANKL, VLA1, VLA-6, a ligand that specifically binds with CD83, and the like. Thus, while the invention is exemplified primarily with regions of CD28, DAP10, and/or 4-1BB as the CS domain, other costimulatory elements are within the scope of the invention.

The ICS domain and the CS domain(s) of the CAR of the invention may be linked to each other in a random or specified order. Optionally, a short oligo- or polypeptide linker, preferably between 2 and 10 amino acids in length may form the linkage. A glycine-serine doublet provides a particularly suitable linker.

In one embodiment, the CAR is designed to comprise a cytoplasmic signaling sequence of CD3 ζ as the ICS domain and comprise a cytoplasmic signaling sequence of CD28 as the CS domain. In another embodiment, the CAR is designed to comprise a cytoplasmic signaling sequence of CD3 t as the ICS domain and comprise a cytoplasmic signaling sequence of DAP10 as the CS domain. In yet another embodiment, the CAR is designed to comprise a cytoplasmic signaling sequence of CD3 as the ICS domain and comprise a cytoplasmic signaling sequence of 4-1BB as the CS domain. Such a cytoplasmic signaling sequence of CD3 ζ may be at least 85%, 86%, 87%, 88%, 89%, 90%, 91%, 92%, 93%, 94%, 95%, 96%, 97%, 98%, 99%, or 100% identical to the CD3 ζ ICS domain comprising the amino acid sequence of human CD3z ICS (SEQ ID NO: 147) or mouse CD3z ICS (SEQ ID NO: 747). Such a cytoplasmic signaling sequence of CD3 zeta may be encoded by a nucleic acid sequence at least 85%, 86%, 87%, 88%, 89%, 90%, 91%, 92%, 93%, 94%, 95%, 96%, 97%, 98%, 99%, or 100% identical to SEQ ID NO: 247 or SEQ ID NO: 847.

Such a cytoplasmic signaling sequence of CD28 may be at least 85%, 86%, 87%, 88%, 89%, 90%, 91%, 92%, 93%, 94%, 95%, 96%, 97%, 98%, 99%, or 100% identical to the sequence of human CD28 CS domain (SEQ ID NO: 156) or mouse CD28 CS domain (SEQ ID NO: 756). Such a cytoplasmic signaling sequence of CD28 may be encoded by a nucleic acid sequence at least 85%, 86%, 87%, 88%, 89%, 90%, 91%, 92%, 93%, 94%, 95%, 96%, 97%, 98%, 99%, or 100% identical to SEQ ID NO: 256 or SEQ ID NO: 856. Such a cytoplasmic signaling sequence of DAP10 may be at least 85%, 86%, 87%, 88%, 89%, 90%, 91%, 92%, 93%, 94%, 95%, 96%, 97%, 98%, 99%, or 100% identical to the sequence of human 4-1BB CS domain (SEQ ID NO: 157) or mouse 4-1 BE domain (SEQ ID NO: 757). Such a cytoplasmic signaling sequence of 4-1BB may be encoded by a nucleic acid sequence at least 85%, 86%, 87%, 88%, 89%, 90%, 91%, 92%, 93%, 94%, 95%, 96%, 97%, 98%, 99%, or 100% identical to SEQ ID NO: 257 or SEQ ID NO: 857. Such a cytoplasmic signaling sequence of DAP10 may be at least 85%, 86%, 87%, 88%, 89%, 90%, 91%, 92%, 93%, 94%, 95%, 96%, 97%, 98%, 99%, or 100% identical to the sequence of human DAP10 CS domain (SEQ ID NO: 158) or mouse DAP10 CS domain (SEQ ID NO: 758). Such a cytoplasmic signaling sequence of DAP10 may be encoded by a nucleic acid sequence at least 85%, 86%, 87%, 88%, 89%, 90%, 91%, 92%, 93%, 94%, 95%, 96%, 97%, 98%, 99%, or 100% identical to SEQ ID NO: 258 or SEQ ID NO: 858.

AB+TM Domain (when AB Domain is Derived from TWEAK)

As described above, the AB domain of the CAR of the present invention may be derived from TWEAK, which a type II membrane protein. In some embodiments, the whole TWEAK sequence (without the first methionine) may be included in the CAR sequence. Human and mouse TWEAK sequences may be SEQ ID NOS: 134 and 135 respectively, and may be encoded by the nucleic acid sequences SEQ ID NOS: 234 and 235, respectively. When the whole TWEAK sequence (without the first methionine) is included in the CAR, both the AB domain and the TM domain of the CAR are included in the TWEAK sequence. In some particular embodiments, the AB domain may contain the amino acid sequence corresponding to the portion within TWEAK that binds to Fn14.

In some embodiments, the CAR comprises an amino acid sequence at least 80%, at least 85%, at least 90%, at least 95%, at least 98% at least 99%, or 100% identical to the amino acid sequence of human TWEAK or mouse TWEAK (SEQ ID NO: 134, or 135, respectively), or to the amino acid sequence encoded by SEQ ID NO: 234, or 235, Exemplary CAR Constructs In the following CAR examples, the CAR construct is described as "AB domain-hinge-TM domain-CS domain-ICS domain" (except for the construct where the AB domain is derived from TWEAK, in which case the CAR construct is described as "ICS domain-CS domain-AB+TM domain").

In one embodiment the CAR of the invention may be described as NbMMRm22.84-CD28H-CD28TM-CD28CS-CD3zICS, and may comprise the amino acid sequence as set forth in SEQ ID NO: 160. A nucleic acid sequence encoding such a CAR may comprise the sequence as set forth in SEQ ID NO: 260.

In one embodiment the CAR of the invention may be described as NbMMRm5.38-CD28H-CD28TM-CD28CS-CD3zICS, and may comprise the amino acid sequence as set forth in SEQ ID NO: 161. A nucleic acid sequence encoding such a CAR may comprise the sequence as set forth in SEQ ID NO: 261.

In one embodiment the CAR of the invention may be described as scFvP4A8VHVL-CD28H-CD28TM-CD28CS-CD3zICS, and may comprise the amino acid sequence as set forth in SEQ ID NO: 162. A nucleic acid sequence encoding such a CAR may comprise the sequence as set forth in SEQ ID NO: 262.

In one embodiment the CAR of the invention may be described as scFvP4A8VLVH-CD28H-CD28TM-CD28CS-CD3zICS, and may comprise the amino acid sequence as set forth in SEQ ID NO: 163. A nucleic acid sequence encoding such a CAR may comprise the sequence as set forth in SEQ ID NO: 263.

In one embodiment the CAR of the invention may be described as scFvP3G5VHVL-CD28H-CD28TM-CD28CS-CD3zICS, and may comprise the amino acid sequence as set forth in SEQ ID NO: 164. A nucleic acid sequence encoding such a CAR may comprise the sequence as set forth in SEQ ID NO: 264.

In one embodiment the CAR of the invention may be described as scFvP3G5VLVH-CD28H-CD28TM-CD28CS-CD3zICS, and may comprise the amino acid sequence as set forth in SEQ ID NO: 165. A nucleic acid sequence encoding such a CAR may comprise the sequence as set forth in SEQ ID NO: 265.

In one embodiment the CAR of the invention may be described as CD3zICS-CD28CS-TWEAK, and may comprise the amino acid sequence as set forth in SEQ ID NO: 136. A nucleic acid sequence encoding such a CAR may comprise the sequence as set forth in SEQ ID NO: 236.

In one embodiment the CAR of the invention may be described as NbMMRm22.84-CD28H-CD28TM-41BBCS-CD3zICS, and may comprise the amino acid sequence as set forth in SEQ ID NO: 166. A nucleic acid sequence encoding such a CAR may comprise the sequence as set forth in SEQ ID NO: 266.

In one embodiment the CAR of the invention may be described as NbMMRm5. 38-CD28H-CD28TM-41BBCS-CD3zICS, and may comprise the amino acid sequence as set forth in SEQ ID NO: 167. A nucleic acid sequence encoding such a CAR may comprise the sequence as set forth in SEQ ID NO: 267.

In one embodiment the CAR of the invention may be described as scFvP4A8VHVL-CD28H-CD28TM-41BBCS-CD3zICS, and may comprise the amino acid sequence as set forth in SEQ ID NO: 168. A nucleic acid sequence encoding such a CAR may comprise the sequence as set forth in SEQ ID NO: 268. In one embodiment the CAR of the invention may be described as scFvP4A8VLVH-CD28H-CD28TM-41BBCS-CD3zICS, and may comprise the amino acid sequence as set forth in SEQ ID NO: 169. A nucleic acid sequence encoding such a CAR may comprise the sequence as set forth in SEQ ID NO: 269.

In one embodiment the CAR of the invention may be described as scFvP3 G5VHVL-CD28H-CD28TM-41BBCS-CD3zICS, and may comprise the amino acid sequence as set forth in SEQ ID NO: 170. A nucleic acid sequence encoding such a CAR may comprise the sequence as set forth in SEQ ID NO: 270.

In one embodiment the CAR of the invention may be described as scFvP3G5VLVH-CD28H-CD28TM-41BBCS-CD3zICS, and may comprise the amino acid sequence as set forth in SEQ ID NO: 171. A nucleic acid sequence encoding such a CAR may comprise the sequence as set forth in SEQ ID NO: 271.

In one embodiment the CAR of the invention may be described as CD3zICS-41BBCS-TWEAK, and may comprise the amino acid sequence as set forth in SEQ ID NO; 137. A nucleic acid sequence encoding such a CAR may comprise the sequence as set forth in SEQ ID NO: 237.

In one embodiment the CAR of the invention may be described as NbMMRm22.84-CD28H-CD28TM-DAP1CS-CD3zICS, and may comprise the amino acid sequence as set forth in SEQ ID NO: 172. A nucleic acid sequence encoding such a CAR may comprise the sequence as set forth in SEQ ID NO: 272.

In one embodiment the CAR of the invention may be described as NbMMRm5.38-CD28H-CD28TM-DAP10CS-CD3zICS, and may comprise the amino acid sequence asset forth in SEQ ID NO: 173. A nucleic acid sequence encoding such a CAR may comprise the sequence as set forth in SEQ ID NO: 273.

In one embodiment the CAR of the invention may be described as scFvP4A8VHVL-CD28H-CD28TM-DAP10CS-CD3zICS, and may comprise the amino acid sequence as set forth in SEQ ID NO: 174. A nucleic acid sequence encoding such a CAR may comprise the sequence as set forth in SEQ ID NO: 274.

In one embodiment the CAR of the invention may be described as scFvP4A8VLVH-CD28H-CD28TM-DAP10CS-CD3zICS, and may comprise the amino acid sequence as set forth in SEQ ID NO: 175. A nucleic acid sequence encoding such a CAR may comprise the sequence as set forth in SEQ ID NO: 275.

In one embodiment the CAR of the invention may be described as scFvP3G5VHVL-CD28H-CD28TM-DAP10CS-CD3zICS, and may comprise the amino acid sequence as set forth in SEQ ID NO: 176. A nucleic acid sequence encoding such a CAR may comprise the sequence as set forth in SEQ ID NO: 276.

In one embodiment the CAR of the invention may be described as scFvP3G5VLVH-CD28H-CD28TM-DAP10CS-CD3zICS, and may comprise the amino acid sequence as set forth in SEQ ID NO: 177. A nucleic acid sequence encoding such a CAR may comprise the sequence as set forth in SEQ ID NO: 277.

In one embodiment the CAR of the invention may be described as CD3zICS-DAP10CS-TWEAK, and may comprise the amino acid sequence as set forth in SEQ ID NO: 138. A nucleic acid sequence encoding such a CAR may comprise the sequence as set forth in SEQ ID NO: 238.

In one embodiment the CAR of the invention may be described as NbMMRm22.84-mCD28H-mCD28TM-mCD28CS-mCD3zICS and may comprise the amino acid sequence as set forth in SEQ ID NO: 760. A nucleic acid sequence encoding such a CAR may comprise the sequence as set forth in SEQ ID NO: 860.

In one embodiment the CAR of the invention may be described as NbMMRm5,38-mCD28H-mCD28TM-mCD28CS-mCD3zICS and may comprise the amino acid sequence as set forth in SEQ ID NO: 761. A nucleic acid sequence encoding such a CAR may comprise the sequence as set forth in SEQ ID NO: 861.

In one embodiment the CAR of the invention may be described as scFvP4A8VHVL-mCD28H-mCD28TM-mCD28CS-mCD3zICS and may comprise the amino acid sequence as set forth in SEQ ID NO: 762. A nucleic acid sequence encoding such a CAR may comprise the sequence as set forth in SEQ ID NO: 862.

In one embodiment the CAR of the invention may be described as scFvP4A8VLVH-mCD28H-mCD28TM-mCD28CS-mCD3zICS and may comprise the amino acid sequence as set forth in SEQ ID NO: 763. A nucleic acid sequence encoding such a CAR may comprise the sequence as set forth in SEQ ID NO: 863.

In one embodiment the CAR of the invention may be described as scFvP3G5VHVL-mCD28H-mCD28TM-mCD28CS-mCD3zICS and may comprise the amino acid sequence as set forth in SEQ ID NO: 764. A nucleic acid sequence encoding such a CAR may comprise the sequence as set forth in SEQ ID NO: 864.

In one embodiment the CAR of the invention may be described as scFvP3G5VLVH-mCD2814-mCD28TM-mCD28CS-mCD3zICS and may comprise the amino acid sequence as set forth in SEQ ID NO: 765. A nucleic acid sequence encoding such a CAR may comprise the sequence as set forth in SEQ ID NO: 865.

In one embodiment the CAR of the invention may be described as mCD3zICS-mCD28CS-mTWEAK, and may comprise the amino acid sequence as set forth in SEQ ID NO: 766. A nucleic acid sequence encoding such a CAR may comprise the sequence as set forth in SEQ ID NO: 866.

Exemplary schematics of a CAR construct of some embodiments are shown in FIGS. 4A and 4B. Schematics showing examples of specific CAR constructs of some embodiments are illustrated in FIGS. 6A and 6B. Further examples of specific CAR constructs of some embodiments are illustrated in FIG. 13A.

In some embodiments, a leader sequence may be placed upstream of the polynucleotide sequences encoding the foregoing exemplary CARs. The leader sequence facilitates the expression of the CAR on the cell surface. The polynucleotide sequence of such a lead sequence may be as set forth in SEQ ID NO: 205, which encodes the amino acid sequence as set forth in SEQ ID NO: 105. Any other sequences that facilitate the expression of the CAR on the cell surface may be used.

In the following examples of polynucleotide sequences, the construct for expressing the CAR of the present invention is described as "Leader sequence (LS)-AB domain-hinge-TM domain-CS domain-ICS domain."

A general exemplary schematic of a construct for a LS-containing CAR of the present invention is shown in FIG. 3 left. Schematics showing specific LS-containing constructs that may be used for expressing an exemplary CAR of some embodiments are illustrated in FIG. 7A.

When the AB domain is derived from TWEAK, a type II membrane protein, the LS is not needed and therefore the CAR may be expressed using the same construct (without LS) that are described above.

In one embodiment the polynucleotide sequence for expressing the CAR of the invention may be described as LS-NbMMRm22.84-CD28H-CD28TM-CD28CS-CD3zICS, and may comprise the nucleic acid sequence as set forth in SEQ ID NO: 678. Such nucleic acid sequence encodes the amino acid sequence as set forth in SEQ ID NO: 578.

In one embodiment the polynucleotide sequence for expressing the CAR of the invention may be described as LS-NbMMRm5.38-CD28H-CD28TM-CD28CS-CD3zICS, and may comprise the nucleic acid sequence as set forth in SEQ ID NO: 679. Such nucleic acid sequence encodes the amino acid sequence as set forth in SEQ ID NO: 579.

In one embodiment the polynucleotide sequence for expressing the CAR of the invention may be described as LS-scFvP4A8VHVL-CD28H-CD28TM-CD28CS-CD3zICS, and may comprise the nucleic acid sequence as set forth in SEQ ID NO: 680. Such nucleic acid sequence encodes the amino acid sequence as set forth in SEQ ID NO: 580.

In one embodiment the polynucleotide sequence for expressing the CAR of the invention may be described as LS-scFvP4A8$V_LV_H$-CD28H-CD28TM-CD28CS-CD3zICS, and may comprise the nucleic acid sequence as set forth in SEQ ID NO: 681. Such nucleic acid sequence encodes the amino acid sequence as set forth in SEQ ID NO: 581.

In one embodiment the polynucleotide sequence for expressing the CAR of the invention may be described as LS-scFvP3G5$V_HV_L$-CD28H-CD28TM-CD28CS-CD3zICS, and may comprise the nucleic acid sequence as set forth in SEQ ID NO: 682. Such nucleic acid sequence encodes the amino acid sequence as set forth in SEQ ID NO: 582.

In one embodiment the polynucleotide sequence for expressing the CAR of the invention may be described as LS-scFvP3G5$V_LV_H$-CD28H-CD28TM-CD28CS-CD3zICS, and may comprise the nucleic acid sequence as set forth in SEQ ID NO: 683. Such nucleic acid sequence encodes the amino acid sequence as set forth in SEQ ID NO: 583.

In one embodiment the polynucleotide sequence for expressing the CAR of the invention may be described as LS-NbMMRm22.84-CD28H-CD28TM-41BBCS-CD3zICS, and may comprise the nucleic acid sequence as set forth in SEQ ID NO: 684. Such nucleic acid sequence encodes the amino acid sequence as set forth in SEQ ID NO: 584.

In one embodiment the polynucleotide sequence for expressing the CAR of the invention may be described as LS-NbMMRm5.38-CD28H-CD28TM-41BBCS-CD3zICS, and may comprise the nucleic acid sequence as set forth in SEQ ID NO: 685. Such nucleic acid sequence encodes the amino acid sequence as set forth in SEQ ID NO: 585.

In one embodiment the polynucleotide sequence for expressing the CAR of the invention may be described as LS-scFvP4A8$V_HV_L$-CD28H-CD28TM-41BBCS-CD3zICS, and may comprise the nucleic acid sequence as set forth in SEQ ID NO: 686. Such nucleic acid sequence encodes the amino acid sequence as set forth in SEQ ID NO: 586.

In one embodiment the polynucleotide sequence for expressing the CAR of the invention may be described as LS-scFvP4A8$V_LV_H$-CD28H-CD28TM-41BBCS-CD3zICS, and may comprise the nucleic acid sequence as set forth in SEQ ID NO: 687. Such nucleic acid sequence encodes the amino acid sequence as set forth in (SEQ ID NO: 587.

In one embodiment the polynucleotide sequence for expressing the CAR of the invention may be described as LS-scFvP3G5$V_HV_L$-CD28H-CD28TM-41BBCS-CD3zICS, and may comprise the nucleic acid sequence as set forth in SEQ ID NO: 688. Such nucleic acid sequence encodes the amino acid sequence as set forth in SEQ ID NO: 588.

In one embodiment the polynucleotide sequence for expressing the CAR of the invention may be described as LS-scFvP3G5$V_LV_H$-CD28H-CD28TM-41BBCS-CD3zICS, and may comprise the nucleic acid sequence as set forth in SEQ ID NO: 689. Such nucleic acid sequence encodes the amino acid sequence as set forth in SEQ ID NO: 589.

In one embodiment the polynucleotide sequence for expressing the CAR of the invention may be described as LS-NbMMRm22.84-CD28H-CD28TM-DAP10CS-CD3zICS, and may comprise the nucleic acid sequence as set forth in SEQ ID NO: 690. Such nucleic acid sequence encodes the amino acid sequence as set forth in SEQ ID NO: 590.

In one embodiment the polynucleotide sequence for expressing the CAR of the invention may be described as LS-NbMMRm5.38-CD28H-CD28TM-DAP10CS-CD3zICS, and may comprise the nucleic acid sequence as set forth in SEQ ID NO: 691. Such nucleic acid sequence encodes the amino acid sequence as set forth in SEQ ID NO: 591.

In one embodiment the polynucleotide sequence for expressing the CAR of the invention may be described as LS-scFvP4A8$V_HV_L$-CD28H-CD28TM-DAP10CS-CD3zICS, and may comprise the nucleic acid sequence as set forth in SEQ ID NO: 692. Such nucleic acid sequence encodes the amino acid sequence as set forth in SEQ ID NO: 592.

In one embodiment the polynucleotide sequence for expressing the CAR of the invention may be described as LS-scFvP4A8$V_LV_H$-CD28H-CD28TM-DAP10CS-CD3zICS, and may comprise the nucleic acid sequence as set forth in SEQ ID NO: 693. Such nucleic acid sequence encodes the amino acid sequence as set forth in SEQ ID NO: 593.

In one embodiment the polynucleotide sequence for expressing the CAR of the invention may be described as LS-scFvP3G5VHVL-CD28H-CD28TM-DAP10CS-CD3zICS, and may comprise the nucleic acid sequence as set forth in SEQ ID NO: 694. Such nucleic acid sequence encodes the amino acid sequence as set forth in SEQ ID NO: 594.

In one embodiment the polynucleotide sequence for expressing the CAR of the invention may be described as LS-scFvP3G5$V_LV_H$-CD28H-CD28TM-DAP10CS-CD3zICS, and may comprise the nucleic acid sequence as set forth in SEQ ID NO: 695. Such nucleic acid sequence encodes the amino acid sequence as set forth in SEQ ID NO: 595.

In some embodiments, the polynucleotide sequences for expressing the foregoing exemplary CARs further comprise a T2A ribosomal skip sequence (or also referred to as T2A) and a sequence encoding truncated CD19 (or also referred to as trCD9). In some embodiments, the T2A may comprise a nucleic acid sequence as set forth in SEQ ID NO: 250. In some embodiments, the trCD19 may comprise a nucleic acid sequence of human trCD19 (SEQ ID NO: 251) or a nucleic acid sequence encoding human trCD19 (SEQ ID NO: 151). In some embodiments, the trCD19 may comprise a nucleic acid sequence of mouse trCD19 (SEQ ID NO: 851) or a nucleic acid sequence encoding mouse trCD19 (SEQ ID NO: 751).

When the T2A and trCD19 sequences are placed downstream of the CAR sequence, the translation will be interrupted by the T2A sequence, resulting in two separate translation products, CAR protein and trCD19 protein.

In the following examples of polynucleotide sequences, the construct for expressing the CAR is described as "Lead sequence-AB domain-hinge-TM domain-CS domain-ICS domain-T2A ribosomal skip sequence-truncated CD19." When the AB domain is derived from TWEAK, a type II membrane protein, the LS is not needed and the construct is described as "ICS domain-CS domain-AB+TM domain-T2A ribosomal skip sequence-truncated CD192" General exemplary schematics of constructs for a CAR of the present invention containing LS, T2A, and trCD19 are shown in FIG. 3 right. Schematics showing specific constructs containing LS, T2A, and trCD19 that may be used for expressing an exemplary CAR of some embodiments are illustrated in FIGS. 7B and 7C. Specific constructs containing T2A, and trCD19 that may be used for expressing an exemplary CAR comprising the TWEAK sequence are illustrated in FIG. 13B.

In one embodiment the polynucleotide sequence for expressing the CAR of the invention may be described as LS-NbMMRm22.84-CD28H-CD28TM-CD28CS-CD3zICS-T2A-trCD19, and may comprise the nucleic acid sequence as set forth in SEQ ID NO: 278. Such nucleic acid sequence encodes the amino acid sequence as set forth in SEQ ID NO: 178.

In one embodiment the polynucleotide sequence for expressing the CAR of the invention may be described as LS-NbMMRm5.38-CD28H-CD28TM-CD28CS-CD3zICS-T2A-trCD19, and may comprise the nucleic acid sequence as set forth in SEQ ID NO: 279. Such nucleic acid sequence encodes the amino acid sequence as set forth in SEQ ID NO: 179.

In one embodiment the polynucleotide sequence for expressing the CAR of the invention may be described as LS-scFvP4A8$V_HV_L$-CD28H-CD28TM-CD28CS-CD3zICS-T2A-trCD19, and may comprise the nucleic acid sequence as set forth in SEQ ID NO: 280. Such nucleic acid sequence encodes the amino acid sequence as set forth in SEQ ID NO: 180.

In one embodiment the polynucleotide sequence for expressing the CAR of the invention may be described as LS-scFvP4A8$V_L$V-CD28H-CD28TM-CD28CS-CD3zICS-T2A-trCD19, and may comprise the nucleic acid sequence as set forth in SEQ ID NO: 281. Such nucleic acid sequence encodes the amino acid sequence as set forth in SEQ ID NO: 181.

In one embodiment the polynucleotide sequence for expressing the CAR of the invention may be described as LS-scFvP3G5$V_HV_L$-CD28H-CD28TM-CD28CS-CD3zICS-T2A-trCD19, and may comprise the nucleic acid sequence as set forth in SEQ ID NO: 282. Such nucleic acid sequence encodes the amino acid sequence as set forth in SEQ ID NO: 182.

In one embodiment the polynucleotide sequence for expressing the CAR of the invention may be described as LS-scFvP3G5$V_LV_H$-CD28H-CD28TM-CD28CS-CD3zICS-T2A-trCD19, and may comprise the nucleic acid sequence as set forth in SEQ ID NO: 283. Such nucleic acid sequence encodes the amino acid sequence as set forth in SEQ ID NO: 183.

In one embodiment the polynucleotide sequence for expressing the CAR of the invention may be described as CD3zICS-CD28CS-TWEAK-T2A-trCD19, and may comprise the nucleic acid sequence as set forth in SEQ ID NO: 296. Such nucleic acid sequence encodes the amino acid sequence as set forth in SEQ ID NO: 196.

In one embodiment the polynucleotide sequence for expressing the CAR of the invention may be described as LS-NbMMRm22.84-CD28H-CD28TM-41BBCS-CD3zICS-T2A-trCD19, and may comprise the nucleic acid sequence as set forth in SEQ ID NO 284. Such nucleic acid sequence encodes the amino acid sequence as set forth in SEQ ID NO: 184.

In one embodiment the polynucleotide sequence for expressing the CAR of the invention may be described as LS-NbMMRm5.38-CD28H-CD28TM-41BBCS-CD3zICS-T2A-trCD19, and may comprise the nucleic acid sequence as set forth in SEQ ID NO: 285. Such nucleic acid sequence encodes the amino acid sequence as set forth in SEQ ID NO: 185.

In one embodiment the polynucleotide sequence for expressing the CAR of the invention may be described as LS-scFvP4A8$V_HV_L$-CD28H-CD28TM-41BBCS-CD3zICS-T2A-trCD19, and may comprise the nucleic acid sequence as set forth in SEQ ID NO: 286. Such nucleic acid sequence encodes the amino acid sequence as set forth in SEQ ID NO: 186.

In one embodiment the polynucleotide sequence for expressing the CAR of the invention may be described as LS-scFvP4A8$V_LV_H$-CD28H-CD28TM-41BBCS-CD3zICS-T2A-trCD19, and may comprise the nucleic acid sequence as set forth in SEQ ID NO: 287. Such nucleic acid sequence encodes the amino acid sequence as set forth in SEQ ID NO: 187.

In one embodiment the polynucleotide sequence for expressing the CAR of the invention may be described as LS-scFvP3G5$V_HV_L$-CD28H-CD28TM-41BBCS-CD3zICS-T2A-trCD9, and may comprise the nucleic acid sequence as set forth in SEQ ID NO: 288. Such nucleic acid sequence encodes the amino acid sequence as set forth in SEQ ID NO: 188.

In one embodiment the polynucleotide sequence for expressing the CAR of the invention may be described as LS-scFvP3G5$V_LV_H$-CD28H-CD28TM-41BBCS-CD3zICS-T2A-trCD19, and may comprise the nucleic acid sequence as set forth in SEQ ID NO: 289. Such nucleic acid sequence encodes the amino acid sequence as set forth in SEQ ID NO: 189.

In one embodiment the polynucleotide sequence for expressing the CAR of the invention may be described as CD3zICS-41BBCS-TWEAK-T2A-trCD19, and may comprise the nucleic acid sequence as set forth in SEQ ID NO: 297. Such nucleic acid sequence encodes the amino acid sequence as set forth in SEQ ID NO: 197.

In one embodiment the polynucleotide sequence for expressing the CAR of the invention may be described as LS-NbMMRm22.84-CD28H-CD28TM-DAP10CS-CD3zICS-T2A-trCD19, and may comprise the nucleic acid sequence as set forth in SEQ ID NO: 290. Such nucleic acid sequence encodes the amino acid sequence as set forth in SEQ ID NO: 190.

In one embodiment the polynucleotide sequence for expressing the CAR of the invention may be described as LS-NbMMRm5.38-CD28H-CD28TM-DAP10CS- CD3zICS-T2A-trCD19, and may comprise the nucleic acid sequence as set forth in SEQ ID NO: 291. Such nucleic acid sequence encodes the amino acid sequence as set forth in SEQ ID NO: 191.

In one embodiment the polynucleotide sequence for expressing the CAR of the invention may be described as LS-scFvP4A8$V_HV_L$-CD28H-CD28TM-DAP10CS-CD3zICS-T2A-trCD19, and may comprise the nucleic acid sequence as set forth in SEQ ID NO: 292. Such nucleic acid sequence encodes the amino acid sequence as set forth in SEQ ID NO: 192.

In one embodiment the polynucleotide sequence for expressing the CAR of the invention may be described as LS-scFvP4A8$V_LV_H$-CD28H-CD28TM-DAP10CS-CD3zICS-T2A-trCD19, and may comprise the nucleic acid sequence as set forth in SEQ ID NO: 293. Such nucleic acid sequence encodes the amino acid sequence as set forth in SEQ ID NO: 193.

In one embodiment the polynucleotide sequence for expressing the CAR of the invention may be described as LS-scFvP3G5$V_HV_L$-CD28H-CD28TM-DAP10CS-CD3zICS-T2A-trCD19, and may comprise the nucleic acid sequence as set forth in SEQ ID NO: 294. Such nucleic acid sequence encodes the amino acid sequence as set forth in SEQ ID NO: 194.

In one embodiment the polynucleotide sequence for expressing the CAR of the invention may be described as LS-scFvP3G5$V_L$V-CD28H-CD28TM-DAP10CS-CD3zICS-T2A-trCD19, and may comprise the nucleic acid sequence as set forth in SEQ ID NO: 295. Such nucleic acid sequence encodes the amino acid sequence as set forth in SEQ ID NO: 195.

In one embodiment the polynucleotide sequence for expressing the CAR of the invention may be described as CD3zICS-DAP10CS-TWEAK-T2A-trCD19, and may comprise the nucleic acid sequence as set forth in SEQ ID NO: 298. Such nucleic acid sequence encodes the amino acid sequence as set forth in SEQ ID NO: 198.

In one embodiment the polynucleotide sequence for expressing the CAR of the invention may be described as LS-NbMMRm22.84-mCD28H-mCD28TM-mCD28CS-mCD3zICS-T2A-mtrCD19 and may comprise the nucleic acid sequence as set forth in SEQ ID NO: 778. Such nucleic acid sequence encodes the amino acid sequence as set forth in SEQ ID NO: 878.

In one embodiment the polynucleotide sequence for expressing the CAR of the invention may be described as LS-NbMMRm5.38-mCD28H-mCD28TM-mCD28CS-mCD3zICS-T2A-mtrCD19 and may comprise the nucleic acid sequence as set forth in SEQ ID NO: 779. Such nucleic acid sequence encodes the amino acid sequence as set forth in SEQ ID NO: 879.

In one embodiment the polynucleotide sequence for expressing the CAR of the invention may be described as LS-scFvP4A8$V_HV_L$-mCD28H-mCD28TM-mCD28CS-mCD3zICS-T2A-mtrCD19 and may comprise the nucleic acid sequence as set forth in SEQ ID NO: 780. Such nucleic acid sequence encodes the amino acid sequence as set forth in SEQ ID NO: 880.

In one embodiment the polynucleotide sequence for expressing the CAR of the invention may be described as LS-scFvP4A8$V_LV_H$-mCD28H-mCD28TM-mCD28CS-mCD3zICS-T2A-mtrCD19 and may comprise the nucleic acid sequence as set forth in SEQ ID NO: 781. Such nucleic acid sequence encodes the amino acid sequence as set forth in SEQ ID NO: 881.

In one embodiment the polynucleotide sequence for expressing the CAR of the invention may be described as LS-scFvP3G5$V_HV_L$-1mCD28H-mCD28TM-mCD28CS-mCD3zICS-T2A-mtrCD19 and may comprise the nucleic acid sequence as set forth in SEQ ID NO: 782. Such nucleic acid sequence encodes the amino acid sequence as set forth in SEQ ID NO: 882.

In one embodiment the polynucleotide sequence for expressing the CAR of the invention may be described as LS-scFvP3G5$V_L$V-mCD28H-mCD28TM-mCD28CS-mCD3zICS-T2A-mtrCD9 and may comprise the nucleic acid sequence as set forth in SEQ ID NO: 783. Such nucleic acid sequence encodes the amino acid sequence as set forth in SEQ ID NO: 883.

In one embodiment the polynucleotide sequence for expressing the CAR of the invention may be described as mCD3zICS-mCD28CS-mTWEAK-T2A-mtrCD19, and may comprise the nucleic acid sequence as set forth in SEQ ID NO: 884. Such nucleic acid sequence encodes the amino acid sequence as set forth in SEQ ID NO: 784.

Shown in Table 1 is the summary of examples of constructs for expressing various CAR variations. It should be noted that the variations shown in Table 1 are for illustrative purposes only and other variations are also possible and included in the scope of the present invention.

TABLE 1

Examples of CAR construct variations

| | | Preferred constructs/origins | Additional origins/examples |
|---|---|---|---|
| Leader Sequence | | LS | any sequence that facilitates the expression of CAR on the cell surface |
| AB domain | | anti-CD206 (NbMMRm22.84, NbMMRm5.38); anti-Fn14 (scFvP4A8VHVL, scFvP4A8VLVH, scFvP3G5VHVL, scFvP3G5VLVH); TWEAK-derived sequences | any other variations derived from NbMMRm22.84, NbMMRm5.38, AbP4A8, or AbP3G5; any construct that binds specifically to CD206, or Fn14; any constructs that bind specifically to molecules expressed in a fibrotic setting or molecules expressed by DAMs. |
| Hinge | optional | CD28 | any construct that allows an appropriate link between AB and TM domains |
| TM domain | | CD28 TWEAK-derived sequence (when the AB domain is TWEAK-derived) | CD3 ϵ, CD4, CD5, CD8, CD9, CD16, CD22, CD33, CD37, CD45, CD64, CD80, CD86, CD134, CD137, CD154, TCR α, TCR β, and CD3 zeta, and any other proteins with a TM domain |
| CS domain | optional | CD28, 4-1BB, DAP10 | CD2, CD4, CD5, CD7, CD8 α, CD8 β, CD11a, CD11b, CD11c, CD11d, CD18, CD19, CD27, CD29, CD30, CD40, CD49d, CD49f, CD69, CD84, CD96 (Tactile), CD100 (SEMA4D), CD103, OX40 (CD134), SLAM (SLAMF1, CD150, IPO-3), CD160 (BY55), SELPLG (CD162), DNAM1 (CD226), Ly9 (CD229), SLAMF4 (CD244, 2B4), ICOS (CD278), B7-H3, BAFFR, BTLA, BLAME (SLAMF8), CEACAM1, CDS, CRTAM, GADS, |

TABLE 1-continued

Examples of CAR construct variations

| | | Preferred constructs/origins | Additional origins/examples |
|---|---|---|---|
| | | | GITR, HVEM (LIGHTER), IA4, ICAM-1, IL2R β, IL2R γ, IL7R α, ITGA4, ITGA6, ITGAD, ITGAE, ITGAL, ITGAM, ITGAX, ITGB1, ITGB2, ITGB7, KIRDS2, LAT, LFA-1, LIGHT, LTBR, NKG2C, NKG2D, NKp30, NKp44, NKp46, NKp80 (KLRF1), PAG/Cbp, PD-1, PSGL1, SLAMF6 (NTB-A, Ly108), SLAMF7, SLP-76, TNFR2, TRANCE/RANKL, VLA1, VLA-6, CD83 ligand, and any other molecules with an appropriate cytoplasmic signaling domain. |
| Additional CS domain(s) | optional | CD28, 4-1BB, DAP10 | CD2, CD4, CD5, CD7, CD8 α, CD8 β, CD11a, CD11b. CD11c, CD11d, CD18, CD19, CD27, CD29, CD30, CD40, CD49d, CD49f, CD69, CD84, CD96 (Tactile), CD100 (SEMA4D), CD103, OX40 (CD134), SLAM (SLAMF1, CD150, IPO-3), CD160 (BY55), SELPLG (CD162), DNAM1 (CD226), Ly9 (CD229), SLAMF4 (CD244, 2B4), ICOS (CD278), B7-H3, BAFFR, BTLA, BLAME (SLAMF8), CEACAM1, CDS, CRTAM, GADS, GITR, HVEM (LIGHTER), IA4, ICAM-1, IL2R β, IL2R γ, IL7R-α, ITGA4, ITGA6, ITGAD, ITGAE, ITGAL, ITGAM, ITGAX, ITGB1, ITGB2, ITGB7, KIRDS2, LAT, LFA-1, LIGHT, LTBR, NKG2C, NKG2D, NKp30, NKp44, NKp46, NKp80 (KLRF1), PAG/Cbp, PD-1, PSGL1, SLAMF6 (NTB-A, Ly108), SLAMF7, SLP-76, TNFR2, TRANCE/RANKL, VLA1, VLA-6, CD83 ligand, and any other molecules with an appropriate cytoplasmic signaling domain. |
| ICS domain | | CD3 ζ | a lymphocyte receptor chain, a TCR/CD3 complex protein, an Fc receptor (FcR) subunit, and an IL-2 receptor subunit, FcR γ, FcR β, CD3 γ, CD3 δ, CD3 ϵ, CD5, CD22, CD66d, CD79a, CD79b, CD278 (ICOS), Fc ϵ RI, DAP10, DAP12, and any other molecules with an appropriate cytoplasmic signaling domain. |

TABLE 1-continued

Examples of CAR construct variations

| | | Preferred constructs/origins | Additional origins/examples |
|---|---|---|---|
| Skip sequence + expression/ purification marker | optional | T2A + trCD19 | any sequence that allows translational skip + any construct that allows confirmation of CAR expression and/or purification of CAR-expressing cells |

Fibrotic Disease-Modifying Molecule (FDDM)

CAR-expressing cells may be further modified to improve the therapeutic advantage of using the cells. In fact, such a strategy is shown to be successful in several cases. For example, human anti-carbonic anhydrase IX (CAIX) CAR T cells engineered to secrete anti-PD-L1 antibody were significantly more effective in reducing tumor growth in a humanized mouse model of renal carcinoma compared to the control CAR T cells not engineered to secrete anti-PD-L1 antibody (Suarez, E. R., Chimeric antigen receptor T cells secreting anti-PD-L1 antibodies more effectively regress renal cell carcinoma in a humanized mouse model. *Oncotarget.* 2016 Jun. 7; 7(23):34341-55).

In some embodiments of the present invention, the CAR-expressing cells as described above may further comprise exogenously introduced polynucleotides encoding a fibrotic disease-modifying molecule (FDMM).

The exogenously introduced polynucleotides encoding an FDMM and the CAR construct may be introduced into the cell using a single vector. When one vector is used for both a CAR and an FDMM, the CAR and the FDMM may be encoded in the vector under the same promoter in cis. In such cases, the CAR and FDMM constructs may be separated by a sequence that allows generation of two separate translation products, for example the IRES sequence or T2A sequence (encoded by SEQ ID NO: 250). Examples of such vector constructs are illustrated in FIGS. 12A, 12B, and 13C.

Additionally, vectors may also be designed for expressing a CAR and an FDMM in the same cell by placing a CAR construct and GRX construct under separate promoters in one vector. The CAG promotor may be one example of appropriate promoters for expressing an FDMM.

Alternatively, a CAR construct and FDMM construct may be contained in separate vectors for transducing cells using two or more different vectors.

In some embodiments, the FDMM may be an anti-fibrotic molecule. Preferred examples of the FDMM include glutaredoxins (GRXs).

In some preferred embodiments, the FDMM is human glutaredoxin 1 (hGRX1). In humans, GRX1 is encoded by the GLRX gene on chromosome 5, with gene location 5p15 (NCBI Reference Sequence: NC_000005.10). hGRX1 has an amino acid sequence provided as NCBI Reference Sequence: NP_001230588.1, NP_001112362.1, NP_001230587.1, or NP_002055.1, or the equivalent residues from a non-human species, e.g., mouse, rodent, monkey, ape, and the like. In one aspect, hGRX1 has the sequence provided as SEQ ID NO: 301, or the equivalent residues from a non-human species, e.g., mouse, rodent, monkey, ape, and the like. In one aspect, hGRX1 may be encoded by the nucleic acid sequence SEQ ID NO: 401.

In some preferred embodiments, the FDMM is human glutaredoxin 2 (hGRX2). In humans, GRX2 is encoded by the GLRX2 gene on chromosome 1, with gene location 1p31.2 (NCBI). hGRX2 has an amino acid sequence provided as NCBI Reference Sequence: NP_001230328.1, NP_001306220.1, or NP_057150.2, or the equivalent residues from a non-human species, e.g., mouse, rodent, monkey, ape, and the like. In one aspect, hGRX2 has the sequence provided as SEQ ID NO: 302, or the equivalent residues from a non-human species, e.g., mouse, rodent, monkey, ape, and the like. In one aspect, hGRX2 may be encoded by the nucleic acid sequence SEQ ID NO: 402.

In some preferred embodiments, the FDMM is human glutaredoxin 3 (hGRX3). In humans, GRX3 is encoded by the GLRX3 gene on chromosome 10, with gene location 10q26.3 (NCBI Reference Sequence: NC_000010.11). hGRX3 has an amino acid sequence provided as GenBank Accession Number: AAH05289.1, or the equivalent residues from a non-human species, e.g., mouse, rodent, monkey, ape, and the like. In one aspect, hGRX3 has the sequence provided as SEQ ID NO: 303, or the equivalent residues from a non-human species, e.g., mouse, rodent, monkey, ape, and the like. In one aspect, hGRX3 may be encoded by the nucleic acid sequence SEQ ID NO: 403.

In some preferred embodiments, the FDMM is human glutaredoxin 5 (hGRX5). In humans, GRX5 is encoded by the GLRX3 gene on chromosome 14, with gene location 1432.13 (NCBI Reference Sequence: NC_000014.9). hGRX5 has an amino acid sequence provided GenBank Accession Number: AAH23528.2, or the equivalent residues from a non-human species, e.g., mouse, rodent, monkey, ape, and the like. In one aspect, hGRX3 has the sequence provided as SEQ ID NO: 305, or the equivalent residues from a non-human species, e.g., mouse, rodent, monkey, ape, and the like. In one aspect, hGRX3 may be encoded by the nucleic acid sequence SEQ ID NO: 405.

In some preferred embodiments, the FDMM is mouse glutaredoxin 1 (mGRX1). In mice, GRX1 is encoded by the Glrx gene on chromosome 13, with gene location 13 C1; 13 40.95 cM (NCBI). mGRX1 has an amino acid sequence provided as NCBI Reference Sequence: NP_444338.2, or the equivalent residues from a non-mouse species, e.g., human, rodent, monkey, ape, and the like. In one aspect, mGRX1 has the sequence provided as SEQ ID NO: 311, or the equivalent residues from a non-mouse species, e.g., human, rodent, monkey, ape, and the like. In one aspect, mGRX1 may be encoded by the nucleic acid sequence SEQ ID NO: 411.

In some embodiments, the FDMM is a functional variant of a wild type GRX. The FDMM may be any variant derived from a wild type GRX that still has the enzymatic function of glutaredoxin. The enzymatic function of the variant may be as potent as, more potent than, or less potent than that of the wild type. Various mutations in GRXs were published in the past, including mutations in the enzyme's active site (Johansson, C., Human Mitochondrial Glutaredoxin Reduces S-Glutathionylated Proteins with High Affinity Accepting Electrons from Either Glutathione or Thioredoxin Reductase. *J Biol Chem.* 2004. Feb. 27: 279(9): p. 7537-43) or the putative caspase cleavage site (see U.S. Pat. No. 8,679,811B2) and mutations of cysteines that may help reduce oxidization or intramolecular disulfide bond formation (Sagemark, J., et al., "Redox properties and evolution of human glutaredoxins," *Proteins.* 2007 Sep. 1; 68(4): p. 879-92).

In some embodiments, the FDMM is a functional variant of hGRX1. In some embodiments, the functional GRX variant has an amino acid sequence at least 80%, at least 85%, at least 90%, at least 95%, at least 98% at least 99%, or 100% identical to human GRX1 variant 2 (hGRX1v2), or human GRX1 variant 12 (hGRX1v12) (SEQ ID NO: 322 or 332, respectively). hGRX1v2 and hGRX1v12 may be encoded by SEQ ID NO: 422 or 432, respectively.

In another embodiment, the FDMM is a functional variant of hGRX2.

In another embodiment, the FDMM is a functional variant of hGRX3.

In another embodiment, the FDMM is a functional variant of hGRX5.

In yet another embodiment, the FDMM is a functional variant of mGRX1.

In some preferred embodiments, the FDMM is glutathione S-transferase pi (GSTP).

In some preferred embodiments, the FDMM is human GSTP. In humans, GSTP is encoded by the GSTP1 gene on chromosome 11, with gene location 11q13.2 (NCBI Reference Sequence: NC_000011.10). hGSTP has an amino acid sequence provided as GenBank Accession Number: AAA56823.1, AAP72967.1, AAV38752.1, or GenBank: AAV38753.1, or the equivalent residues from a non-human species, e.g., mouse, rodent, monkey, ape, and the like. In one aspect, hGSTP has the sequence provided as SEQ ID NO: 341, or the equivalent residues from a non-human species, e.g., mouse, rodent, monkey, ape, and the like. In one aspect, hGSTP may be encoded by the nucleic acid sequence SEQ ID NO: 441.

In some preferred embodiments, the FDMM is mouse GSTP. In mice, GSTP is encoded by the Gstp1 gene on chromosome 19, with gene location 19 A; 19 3.75 cM (NCBI Reference Sequence: NC_000085.6). mGSTP has an amino acid sequence provided as GenBank Accession Number: GenBank: AAH61109.1, or the equivalent residues from a non-mouse species, e.g., human, rodent, monkey, ape, and the like. In one aspect, mGSTP has the sequence provided as SEQ ID NO: 351, or the equivalent residues from a non-human species, e.g., mouse, rodent, monkey, ape, and the like. In one aspect, mGSTP may be encoded by the nucleic acid sequence SEQ ID NO: 451.

In yet another embodiment, the FDMM is a functional variant of hGSTP or mGSTP.

Furthermore, Inventors recently found that IL-37 polymorphism is associated with SSc and results in reduced amounts of functional or active IL-37 in SSc patients.

Our preliminary data suggest deleterious IL-37 variants in SSc patients may increase their inflammatory responses. We sequenced the transcriptomes of 41 SSc patients with limited and diffuse cutaneous disease and 14 age and gender-matched healthy controls to single nucleotide resolution. We then screened for coding region variants associated with SSc (Whitfield, unpublished data) and identified a naturally occurring variant in IL-37 (IL-37 rs2723187) enriched in patients with diffuse SSc in two separate cohorts. The rs2723187 SNP results in a C to T transition and causes a proline to leucine (P-L) amino acid change at position 108 (p.P108L) in IL-37. Analysis with PolyPhen-2, a tool that predicts the functional consequences of the amino acid changes, predicts this substitution is highly damaging (score=0.999) since proline is more rigid than leucine, which likely affects secondary structure of the IL-37 protein.

Our results demonstrate an allele frequency of 14.9% in the SSc patients for this SNP compared to an allele frequency of 7.1% in controls. Case-control burden ratio analysis showed that the IL-37 rs2723187 variant in SSc has an occurrence rate 2.08 times that of healthy controls and an occurrence rate 1.87 times that of Caucasian patients sequenced as part of the 1000 Genomes Project. Intriguingly, IL-37 rs2723187 is present with a higher allele frequency in individuals of African descent compared to those of European descent. This finding may be significant as African American SSc patients have more severe disease manifestations compared with Caucasians (Steen, V. D. and T. A. Medsger, Changes in causes of death in systemic sclerosis, 1972-2002. *Ann Rheum Dis,* 2007. 66(7): p. 940-4.)

To determine how the p.P108L SNP affects IL-37 function, we used Hapmap B-cells with known IL-37 genotypes: homozygous reference (Ref/Ref), heterozygous (Ref/Var) or homozygous variant (Var/Var). As indicated in FIG. 14, cells were stimulated with the TLR9 agonist CpG DNA for 72 hours and secreted IL-6 protein levels were measured by ELISA. IL-6 protein production increased four-fold in IL-37 heterozygous and homozygous variant cell lines compared with the homozygous reference cell lines, indicating greater immune activation in the presence of the IL-37 SNP (FIG. 14, $p<0.01$). STAT3 phosphorylation, which is induced by IL-6, was also increased in IL-37 heterozygous cells compared homozygous references (data not shown). We find increased IL-6 and STAT3 mRNA expression in SSc patients carrying the variant (not shown). Given that IL-6 is known to play an important role in the progression of SSc, and tocilizumab, which is an IL-6R blocker, improves SSc patient outcomes (Elhai, M., et al., "Outcomes of patients with systemic-sclerosis-associated polyarthritis and myopathy treated with tocilizumab or abatacept: a EUSTAR observational study", *Ann Rheum Dis,* 2013. 72(7): p. 1217-20.). Secreting IL-37 in patients with this deleterious IL-37 variant may be useful therapeutically as a means of regulating immune activation in SSc.

Based on this finding, having the CAR-expressing cells also produce functional or active IL-37 may be therapeutically effective for SSc. Therefore, in some embodiments, the FDMM may be IL-37.

As described above, clinical trial results on SSc patients demonstrated the therapeutic efficacy of antibodies against TGF-β (tresolimumab) and IL-6 (toclizumab) respectively. Therefore, in some preferred aspects, the FDMM is capable of inhibiting, blocking, silencing, inactivating, or performing a similar function against TGF-β or TGF-β receptor. In some preferred aspects, the FDMM is capable of inhibiting, blocking, silencing, inactivating, or performing a similar function against IL-6 or IL-6 receptor.

In some embodiments, the FDMM may be selected based on searches conducted using the Open Targets Platform. Genes associated with a specific disease of interest may be searched by typing the disease name at https://targetvalidation.org/. The search will provide a list of molecules that can be altered, at the protein, RNA, DNA, or any other levels, using any possible method, for the treatment of the disease.

According to the website (see https://targetvalidation.org/faq), calculation of the association score is explained as follows: "We calculate a score for each evidence from the different data sources (e.g. GWAS catalog, EVA) to summarize the strength of the evidence. The score will depend on factors that affect the relative strength of an evidence, for example p values and sample size for the GWAS data. Once we have the scores for each evidence, we calculate an overall score by taking into account the sum of the harmonic progression of each score and adjusting the contribution of each of them using a heuristic weighting." The association score is described in the range of 0 to 1, 1 being the score indicating the strongest disease association.

For example, in case of SSc, Table 2 shows the top 69 genes associated with SSc, whose association score is 0.1 or above, according to the Open Targets Platform. The 69 genes or the gene products represent good therapeutic targets for SSc. The entire gene list (873 target genes in total for SSc) can be found at https://targetvalidation.org/disease/EFO_0000717/associations.

TABLE 2

Top 69 genes associated with SSc

| target. gene_info. symbol | association _score. overall | association_score. datatypes. genetic_association | association_score. datatypes. literature | target. gene_info.name |
|---|---|---|---|---|
| EDNRA | 1 | 0 | 0.042259289 | endothelin receptor type A |
| EDNRB | 1 | 0 | 0.038417 | endothelin receptor type B |
| IL6R | 0.8821 | 0 | 0.0284 | interleukin 6 receptor |
| PDGFRB | 0.80037809 | 0 | 0.071623472 | platelet derived growth factor receptor β |
| HMGCR | 0.76085 | 0 | 0.0434 | 3-hydroxy-3-methylglutaryl-CoA reductase |
| PDE5A | 0.7548 | 0 | 0.0192 | phosphodiesterase 5A |
| STAT4 | 0.739139061 | 0.724404896 | 0.058936659 | signal transducer and activator of transcription 4 |
| PDGFRA | 0.714804169 | 0 | 0.059216678 | platelet derived growth factor receptor α |
| KDR | 0.712041667 | 0 | 0.048166667 | kinase insert domain receptor |
| FLT1 | 0.710163889 | 0 | 0.040655556 | fms related tyrosine kinase 1 |
| HLA-DQB1 | 0.706257778 | 0.695138889 | 0.044475557 | major histocompatibility complex, class II, DQ β 1 |

TABLE 2-continued

Top 69 genes associated with SSc

| target. gene_info. symbol | association _score. overall | association_score. datatypes. genetic_association | association_score. datatypes. literature | target. gene_info.name |
|---|---|---|---|---|
| FGFR3 | 0.7 | 0 | 0 | fibroblast growth factor receptor 3 |
| FGFR1 | 0.7 | 0 | 0 | fibroblast growth factor receptor 1 |
| FLT4 | 0.7 | 0 | 0 | fms related tyrosine kinase 4 |
| FGFR2 | 0.7 | 0 | 0 | fibroblast growth factor receptor 2 |
| FGFR4 | 0.7 | 0 | 0 | fibroblast growth factor receptor 4 |
| IRF8 | 0.48339799 | 0.46932299 | 0.0563 | interferon regulatory factor 8 |
| CD247 | 0.471341384 | 0.460916384 | 0.0417 | CD247 molecule |
| TNIP1 | 0.454687086 | 0.443116808 | 0.046281111 | TNFAIP3 interacting protein 1 |
| ITGAM | 0.442108333 | 0.433333333 | 0.0351 | integrin subunit α M |
| SOX5 | 0.360761158 | 0.360761158 | 0 | SRY-box 5 |
| ZC3H10 | 0.312946779 | 0.312946779 | 0 | zinc finger CCCH-type containing 10 |
| TNFAIP3 | 0.302058028 | 0.289965667 | 0.048369444 | TNF α induced protein 3 |
| BLK | 0.297204353 | 0.266666667 | 0.049839179 | BLK proto-oncogene, Src family tyrosine kinase |
| ANKS1A | 0.282658079 | 0.282658079 | 0 | ankyrin repeat and sterile α motif domain containing 1A |
| PTGIR | 0.282472222 | 0 | 0 | prostaglandin I2 (prostacyclin) receptor (IP) |
| KIT | 0.271161111 | 0 | 0.0152 | KIT proto-oncogene receptor tyrosine kinase |
| ABL1 | 0.267361111 | 0 | 0 | ABL proto-oncogene 1, non-receptor tyrosine kinase |
| GRB10 | 0.26 | 0.26 | 0 | growth factor receptor bound protein 10 |
| C15orf39 | 0.250762625 | 0.250762625 | 0 | chromosome 15 open reading frame 39 |
| TNFSF4 | 0.230657945 | 0.213264667 | 0.069573111 | TNF superfamily member 4 |
| LAMC2 | 0.2297113 | 0.2297113 | 0 | laminin subunit γ 2 |
| IKZF3 | 0.223379085 | 0.223379085 | 0 | IKAROS family zinc finger 3 |
| IL13 | 0.218390542 | 0 | 0.073562167 | interleukin 13 |
| TNFSF13B | 0.214571373 | 0 | 0.058285493 | TNF superfamily member 13b |
| MS4A1 | 0.208355111 | 0 | 0.033420444 | membrane spanning 4-domains A1 |
| SCN4A | 0.2 | 0 | 0 | sodium voltage-gated channel α subunit 4 |
| SCN2A | 0.2 | 0 | 0 | sodium voltage-gated channel α subunit 2 |
| SCN8A | 0.2 | 0 | 0 | sodium voltage-gated channel α subunit 8 |
| SCN11A | 0.2 | 0 | 0 | sodium voltage-gated channel α subunit 11 |
| SCN7A | 0.2 | 0 | 0 | sodium voltage-gated channel α subunit 7 |
| SCN3A | 0.2 | 0 | 0 | sodium voltage-gated channel α subunit 3 |
| SCN10A | 0.2 | 0 | 0 | sodium voltage-gated channel α subunit 10 |

TABLE 2-continued

| Top 69 genes associated with SSc | | | | |
|---|---|---|---|---|
| target. gene_info. symbol | association _score. overall | association_score. datatypes. genetic_association | association_score. datatypes. literature | target. gene_info.name |
| SCN5A | 0.2 | 0 | 0 | sodium voltage-gated channel α subunit 5 |
| SCN9A | 0.2 | 0 | 0 | sodium voltage-gated channel α subunit 9 |
| SCN1A | 0.2 | 0 | 0 | sodium voltage-gated channel α subunit 1 |
| RHOB | 0.195015403 | 0.184095958 | 0.043677778 | ras homolog family member B |
| FKBP1A | 0.1287 | 0 | 0.0148 | FK506 binding protein 1A |
| SRC | 0.119418425 | 0 | 0.077673702 | SRC proto-oncogene, non-receptor tyrosine kinase |
| CD19 | 0.113859085 | 0 | 0.055436339 | CD19 molecule |
| CTGF | 0.111719877 | 0 | 0.111719877 | connective tissue growth factor |
| CD109 | 0.1103 | 0 | 0.1103 | CD109 molecule |
| VDR | 0.1074 | 0 | 0.0296 | vitamin D (1,25-dihydroxyvitamin D3) receptor |
| DKK1 | 0.106788889 | 0 | 0.106788889 | dickkopf WNT signaling pathway inhibitor 1 |
| IL6 | 0.105553644 | 0 | 0.105553644 | interleukin 6 |
| SERPINH1 | 0.103844444 | 0 | 0.103844444 | serpin family H member 1 |
| NR3C1 | 0.1037 | 0 | 0.0148 | nuclear receptor subfamily 3 group C member 1 |
| TGFB1 | 0.102780218 | 0 | 0.102780218 | transforming growth factor β 1 |
| EPHA2 | 0.1 | 0 | 0 | EPH receptor A2 |
| SRMS | 0.1 | 0 | 0 | src-related kinase lacking C-terminal regulatory tyrosine and N-terminal myristylation sites |
| DHFR | 0.1 | 0 | 0 | dihydrofolate reductase |
| HCK | 0.1 | 0 | 0 | HCK proto-oncogene, Src family tyrosine kinase |
| YES1 | 0.1 | 0 | 0 | YES proto-oncogene 1, Src family tyrosine kinase |
| LYN | 0.1 | 0 | 0 | LYN proto-oncogene, Src family tyrosine kinase |
| FYN | 0.1 | 0 | 0 | FYN proto-oncogene, Src family tyrosine kinase |
| ALDH5A1 | 0.1 | 0 | 0 | aldehyde dehydrogenase 5 family member A1 |
| FRK | 0.1 | 0 | 0 | fyn related Src family tyrosine kinase |
| LCK | 0.1 | 0 | 0 | LCK proto-oncogene, Src family tyrosine kinase |
| FOR | 0.1 | 0 | 0 | FGR proto-oncogene, Src family tyrosine kinase |

In some embodiments, the FDMM has the ability to stimulate, inhibit, block, agonize, antagonize, silence, overexpress, inactivate, activate, or perform a similar function against, a target selected from the 69 targets listed in Table 2.

In a preferred aspect, the FDMM alters (i.e., stimulates, inhibits, blocks, agonizes, antagonizes, silences, overexpress, inactivates, activates, or performs a similar function thereof against) endothelin receptor type A (EDNRA), endothelin receptor type B (EDNRB), interleukin 6 receptor (IL6R), platelet derived growth factor receptor β (PDGFRB), 3-hydroxy-3-methylglutaryl-CoA reductase (HMGCR), phosphodiesterase 5A (PDE5A), signal transducer and activator of transcription 4 (STAT4), platelet derived growth factor receptor α(PDGFRA), kinase insert domain receptor (KDR), fins related tyrosine kinase 1 (FLT), major histocompatibility complex, class II, DQ β1 (HLA-DQB1), fibroblast growth factor receptor 3 (FGFR3), fibroblast growth factor receptor 1 (FGFR1), fms related tyrosine kinase 4 (FLT4), fibroblast growth factor receptor 2 (FGFR2), or fibroblast growth factor receptor 4 (FGFR4).

In some embodiments, the FDMM is a molecule capable of altering the inflammation state. Examples of such molecules include cytokines or chemokines associated with M1 MPs, such as IL-12, TNF-α, and IFN-γ. Such cytokines are known in the art to be able to convert alternatively activated MPs to conventionally activated MPs or M1 MPs.

While Table 2 is provided as the list of molecules that may be altered (i.e., stimulated, inhibited, blocked, agonized, antagonized, silenced, overexpressed, inactivated, activated, etc), depending on the context and need, those molecules may also be utilized as the target molecule of a CAR of the present invention.

Further Modification

The CARs of the present invention, nucleotide sequences encoding the same, vectors encoding the same, and cells comprising nucleotide sequences encoding said CARs may be further modified, engineered, optimized, or appended in order to provide or select for various features. These features may include, but are not limited to, efficacy, persistence, target specificity, reduced immunogenicity, multi-targeting, enhanced immune response, expansion, growth, reduced off-target effect, reduced subject toxicity, improved target cytotoxicity, improved attraction of disease alleviating immune cells, detection, selection, targeting, and the like. For example, the cells may be engineered to express another CAR, or to have a suicide mechanism, and may be modified to remove or modify expression of an endogenous receptor or molecule such as a TCR and/or MHC molecule.

In some embodiments, the vector or nucleic acid sequence encoding the CAR further encodes other genes. The vector or nucleic acid sequence may be constructed to allow for the co-expression of multiple genes using a multitude of techniques including co-transfection of two or more plasmids, the use of multiple or bidirectional promoters, or the creation of bicistronic or multicistronic vectors. The construction of multicistronic vectors may include the encoding of IRES elements or 2A peptides, such as T2A, P2A, E2A, or F2A (for example, see Kim, J. H., et al., "High cleavage efficiency of a 2A peptide derived from porcine teschovirus-1 in human cell lines, zebrafish and mice", *PLoS One.* 2011; 6(4)), In a particular embodiment, the nucleic acid sequence or vector encoding the CAR further encodes tCD19 with the use of a T2A ribosomal skip sequence. In one embodiment, the T2A ribosomal skip sequence comprises the nucleic acid sequence as set forth in SEQ ID NO: 250. In one embodiment, the T2A ribosomal skip sequence encodes the amino acid sequence of SEQ ID NO: 150.

The CAR expressing cell may further comprise a disruption to one or more endogenous genes. In some embodiments, the endogenous gene encodes TCRα, TCRβ, CD52, glucocorticoid receptor (GR), deoxycytidine kinase (dCK), or an immune checkpoint protein such as, for example, programmed death-1 (PD-1).

Efficacy

The CARs of the present invention and cells expressing these CARs may be further modified to improve efficacy against cells expressing the target molecule. The cells may be, for example, DAMs or disease associated cells expressing Fn14. The cells expressing Fn14 may be DAMs, fibroblasts, or epithelial cells. In some embodiments, the improved efficacy may be measured by increased cytotoxicity against cells expressing the target molecule, for example cytotoxicity against DAMs or disease associated cells expressing Fn14. In some embodiments, the improved efficacy may also be measured by increased production of cytotoxic mediators such as, but not limited to, IFN γ, perforin, and granzyme B. In some embodiments, the improved efficacy may be shown by reduction in the signature cytokines of the diseases, or alleviated symptoms of the disease when the CAR expressing cells are administered to a subject. In case of fibrotic diseases, TGF-β may be used as a signature cytokine. Other cytokines that may be reduced include IL-6, IL-4, IL-10, and/or IL-13. In case of SSc, reduction in skin thickness is an example of alleviated symptoms. In case of autoimmune diseases, reduced responsiveness of autoreactive cells or decrease in autoreactive T cells, B cells, or Abs may represent improved efficacy. In case of cancer, improved efficacy may be shown by better tumor cytotoxicity, better infiltration into the tumor, or reduction of immunosuppressive mediators. In some embodiments, gene expression profiles may be also investigated to evaluate the efficacy of the CAR.

In one aspect, the CAR expressing cells are further modified to evade or neutralize the activity of immunosuppressive mediators, including, but not limited to prostaglandin E2 (PGE2) and adenosine. In some embodiments, this evasion or neutralization is direct. In other embodiments, this evasion or neutralization is mediated via the inhibition of protein kinase A (PKA) with one or more binding partners, for example ezrin. In a specific embodiment, the CAR-expressing cells further express the peptide "regulatory subunit I anchoring disruptor" (RIAD). RIAD is thought to inhibit the association of protein kinase A (PKA) with ezrin, which thus prevents PKA's inhibition of TCR activation (Newick et al. *Cancer Res* 2016 August; 76(15 Suppl):Abstract nr B27).

In some embodiments, the CAR expressing cells of the invention may induce a broad immune response, consistent with epitope spreading.

In some embodiments, the CAR expressing cells of the invention further comprise a homing mechanism. For example, the cell may transgenically express one or more stimulatory chemokines or cytokines or receptors thereof. In particular embodiments, the cells are genetically modified to express one or more stimulatory cytokines. In certain embodiments, one or more homing mechanisms are used to assist the inventive cells to accumulate more effectively to the disease site. In some embodiments, the CAR expressing cells are further modified to release inducible cytokines upon CAR activation, e.g., to attract or activate innate immune cells to a targeted cell (so-called fourth generation CARs or TRUCKS). In some embodiments, CARs may co-express homing molecules, e.g., CCR4 or CCR2b, to increase trafficking to the disease site.

Controlling CAR Expression

In some instances, it may be advantageous to regulate the activity of the CAR or CAR expressing cells CAR. For example, inducing apoptosis using, e.g., a caspase fused to a dimerization domain (see, e.g., Di et al., *N Engl. J. Med.* 2011 Nov. 3; 365(18):1673-1683), can be used as a safety switch in the CAR therapy of the instant invention. In another example, CAR-expressing cells can also express an inducible Caspase-9 (iCaspase-9) molecule that, upon administration of a dimerizer drug (e.g., rimiducid (also called AP1903 (Bellicum Pharmaceuticals) or AP20187 (Ariad)) leads to activation of the Caspase-9 and apoptosis of the cells. The iCaspase-9 molecule contains a chemical inducer of dimerization (CID) binding domain that mediates dimerization in the presence of a CID. This results in inducible and selective depletion of CAR-expressing cells. In some cases, the iCaspase-9 molecule is encoded by a nucleic acid molecule separate from the CAR-encoding vector(s). In some cases, the iCaspase-9 molecule is encoded by the same nucleic acid molecule as the CAR-encoding vector. The iCaspase-9 can provide a safety switch to avoid any toxicity of CAR-expressing cells. See, e.g., Song et al. *Cancer Gene Ther,* 2008; 15(10):667-75; Clinical Trial Id. No. NCT02107963; and Di Stasi et al. *N. Engl. J. Med.* 2011; 365:1673-83.

Alternative strategies for regulating the CAR therapy of the instant invention include utilizing small molecules or antibodies that deactivate or turn off CAR activity, e.g., by deleting CAR-expressing cells, e.g., by inducing antibody dependent cell-mediated cytotoxicity (ADCC). For example, CAR-expressing cells described herein may also express an antigen that is recognized by molecules capable of inducing cell death, e.g., ADCC or compliment-induced cell death. For example, CAR expressing cells described herein may also express a receptor capable of being targeted by an antibody or antibody fragment. Examples of such receptors include EpCAM, VEGFR, integrins (e.g., integrins αvβ3, α4, αI3/4β3, α4β7, α5β1, αvβ3, αv), members of the TNF receptor superfamily (e.g., TRAIL-R1, TRAIL-R2), PDGF Receptor, interferon receptor, folate receptor, GPNMB, ICAM-1, HLA-DR, CEA, CA-125, MUC1, TAG-72, IL-6 receptor, 5T4, GD2, GD3, CD2, CD3, CD4, CD5, CD11, CD11a/LFA-1, CD15, CD18/ITGB2, CD19, CD20, CD22, CD23/IgE Receptor, CD25, CD28, CD30, CD33, CD38, CD40, CD41, CD44, CD51, CD52, CD62L, CD74, CD80, CD125, CD147/basigin, CD152/CTLA-4, CD154/CD40L, CD195/CCR5, CD319/SLAMF7, and EGFR, and truncated versions thereof (e.g., versions preserving one or more extracellular epitopes but lacking one or more regions within the cytoplasmic domain). For example, CAR-expressing cells described herein may also express a truncated epidermal growth factor receptor (EGFR) which lacks signaling capacity but retains the epitope that is recognized by molecules capable of inducing ADCC, e.g., cetuximab (ERBITUX®), such that administration of cetuximab induces ADCC and subsequent depletion of the CAR-expressing cells (see, e.g., WO201/056894, and Jonnalagadda et al., "Gene Ther. 2013; 20(8)853-860).

In some embodiments, the CAR cell comprises a polynucleotide encoding a suicide polypeptide, such as for example RQR8. See, e.g., WO2013153391A, which is hereby incorporated by reference in its entirety. In CAR cells comprising the polynucleotide, the suicide polypeptide may be expressed at the surface of a CAR cell. The suicide polypeptide may also comprise a signal peptide at the amino terminus. Another strategy includes expressing a highly compact marker/suicide gene that combines target epitopes from both CD32 and CD20 antigens in the CAR-expressing cells described herein, which binds rituximab, resulting in selective depletion of the CAR-expressing cells, e.g., by ADCC (see, e.g., Philip et al., "*Blood.* 2014; 124(8)1277-1287). Other-methods for depleting CAR-expressing cells described herein include administration of CAMPATH™, a monoclonal anti-CD52 antibody that selectively binds and targets mature lymphocytes, e.g., CAR-expressing cells, for destruction, e.g., by inducing ADCC. In other embodiments, the CAR-expressing cell can be selectively targeted using a CAR ligand, e.g., an anti-idiotypic antibody. In some embodiments, the anti-idiotypic antibody can cause effector cell activity, e.g., ADCC or ADC activities, thereby reducing the number of CAR-expressing cells. In other embodiments, the CAR ligand, e.g., the anti-idiotypic antibody, can be coupled to an agent that induces cell killing, e.g., a toxin, thereby reducing the number of CAR-expressing cells. Alternatively, the CAR molecules themselves can be configured such that the activity can be regulated, e.g., turned on and off, as described below.

In some embodiments, a regulatable CAR (RCAR) where the CAR activity can be controlled is desirable to optimize the safety and efficacy of a CAR therapy. In some embodiments, a RCAR comprises a set of polypeptides, typically two in the simplest embodiments, in which the components of a standard CAR described herein, e.g., an AB domain and an ICS domain, are partitioned on separate polypeptides or members. In some embodiments, the set of polypeptides include a dimerization switch that, upon the presence of a dimerization molecule, can couple the polypeptides to one another, e.g., can couple an AB domain to an ICS domain. Additional description and exemplary configurations of such regulatable CARs are provided herein and in International Publication No. WO 2015/090229, hereby incorporated by reference in its entirety.

In an aspect, an RCAR comprises two polypeptides or members: 1) an intracellular signaling member comprising an ICS domain, e.g., a primary ICS domain described herein, and a first switch domain; 2) an antigen binding member comprising an AB domain, e.g., that specifically binds a target molecule described herein, as described herein and a second switch domain. Optionally, the RCAR comprises a TM domain described herein. In an embodiment, a TM domain can be disposed on the intracellular signaling member, on the antigen binding member, or on both. Unless otherwise indicated, when members or elements of an RCAR are described herein, the order can be as provided, but other orders are included as well. In other words, in an embodiment, the order is as set out in the text, but in other embodiments, the order can be different. E.g., the order of elements on one side of a transmembrane region can be different from the example, e.g., the placement of a switch domain relative to an ICS domain can be different, e.g., reversed.

In some embodiments, the CAR expressing immune cell may only transiently express a CAR. For example, the cells of the invention may be transduced with mRNA comprising a nucleic acid sequence encoding an inventive CAR. In this vein, the present invention also includes an RNA construct that can be directly transfected into a cell. A method for generating mRNA for use in transfection involves in vitro transcription (IVT) of a template with specially designed primers, followed by polyA addition, to produce a construct containing 3' and 5' untranslated sequences ("UTRs"), a 5' cap and/or Internal Ribosome Entry Site (IRES), the nucleic acid to be expressed, and a polyA tail, typically 50-2000 bases in length. RNA so produced can efficiently transfect different kinds of cells. In one embodiment, the template includes sequences for the CAR. In an embodiment, an RNA CAR vector is transduced into a cell by electroporation.

Target Specificity.

The CAR expressing cells of the present invention may further comprise one or more CARs, in addition to the first CAR. These additional CARs may or may not be specific for the target molecule of the first CAR. In some embodiments, the one or more additional CARs may act as inhibitory or activating CARs. In some aspects, the CAR of some embodiments is the stimulatory or activating CAR; in other aspects, it is the costimulatory CAR. In some embodiments, the cells further include inhibitory CARs (iCARs, see Fedorov et al., *Sci. Transl. Medicine,* 2013 December; 5(215) 215ra172), such as a CAR recognizing an antigen other than the target molecule of the first CAR, whereby an activating signal delivered through the first CAR is diminished or inhibited by binding of the inhibitory CAR to its ligand, e.g., to reduce off-target effects.

In some embodiments, the CAR expressing cells of the present invention may further comprise one or more additional CARs. Examples of targets of such a CAR include Fn14, CD206, CD163, molecules expressed in a fibrotic setting, molecules expressed on DAMs, and molecules listed in Table 2.

In some embodiments, the AB domain of the CAR is or is part of an immunoconjugate, in which the AB domain is conjugated to one or more heterologous' molecule(s), such as, but not limited to, a cytotoxic agent, an imaging agent, a detectable moiety, a multimerization domain, or other heterologous molecule. Cytotoxic agents include, but are not limited to, radioactive isotopes (e.g., At211, I131, I125, Y90, Re186, Re188, Sm153, Bi212, P32, Pb212 and radioactive isotopes of Lu); chemotherapeutic agents; growth inhibitory agents; enzymes and fragments thereof such as nucleolytic enzymes; antibiotics; toxins such as small molecule toxins or enzymatically active toxins. In some embodiments, the AB domain is conjugated to one or more cytotoxic agents, such as chemotherapeutic agents or drugs, growth inhibitory agents, toxins (e.g., protein toxins, enzymatically active toxins of bacterial, fungal, plant, or animal origin, or fragments thereof), or radioactive isotopes.

In some embodiments, to enhance persistence, the cells of the invention may be further modified to overexpress pro-survival signals, reverse anti-survival signals, overexpress Bcl-xL, overexpress hTERT, lack Fas, or express a TGF-β dominant negative receptor. Persistence may also be facilitated by the administration of cytokines, e.g., IL-2, IL-7, and IL-15.

Vectors

The present invention also provides vectors in which a DNA of the present invention is inserted. Vectors derived from retroviruses such as the lentivirus are suitable tools to achieve long-term gene transfer since they allow long-term, stable integration of a transgene and its propagation in daughter cells. Lentiviral vectors have the added advantage over vectors derived from onco-retroviruses such as murine leukemia viruses in that they can transduce non-proliferating cells, such as hepatocytes. They also have the added advantage of low immunogenicity.

In brief summary, the expression of natural or synthetic nucleic acids encoding CARs is typically achieved by operably linking a nucleic acid encoding the CAR polypeptide or portions thereof to a promoter, and incorporating the construct into an expression vector. The vectors can be suitable for replication and integration eukaryotes. Typical cloning vectors contain transcription and translation terminators, initiation sequences, and promoters useful for regulation of the expression of the desired nucleic acid sequence.

The expression constructs of the present invention may also be used for nucleic acid immunization and gene therapy, using standard gene delivery protocols. Methods for gene delivery are known in the art. See, e.g., U.S. Pat. Nos. 5,399,346, 5,580,859, 5,589,466, incorporated by reference herein in their entireties. In another embodiment, the invention provides a gene therapy vector.

The nucleic acid can be cloned into a number of types of vectors. For example, the nucleic acid can be cloned into a vector including, but not limited to a plasmid, a phagemid, a phage derivative, an animal virus, and a cosmid. Vectors of particular interest include expression vectors, replication vectors, probe generation vectors, and sequencing vectors.

Further, the expression vector may be provided to a cell in the form of a viral vector. Viral vector technology is well known in the art and is described, for example, in Sambrook et al. (2001, Molecular Cloning: A Laboratory Manual, Cold Spring Harbor Laboratory, New York), and in other virology and molecular biology manuals. Viruses, which are useful as vectors include, but are not limited to, retroviruses, γ-retroviruses, adenoviruses, adeno-associated viruses, herpes viruses, and lentiviruses. In general, a suitable vector contains an origin of replication functional in at least one organism, a promoter sequence, convenient restriction endonuclease sites, and one or more selectable markers, (e.g., WO 01/96584; WO 01/29058; and U.S. Pat. No. 6,326,193).

A number of viral based systems have been developed for gene transfer into mammalian cells. For example, retroviruses provide a convenient platform for gene delivery systems. A selected gene can be inserted into a vector and packaged in retroviral particles using techniques known in the art. The recombinant virus can then be isolated and delivered to cells of the subject either in vivo or ex vivo. A number of retroviral systems are known in the art. In some embodiments, adenovirus vectors are used. A number of adenovirus vectors are known in the art. In one embodiment, lentivirus vectors are used.

Additional promoter elements, e.g., enhancers, regulate the frequency of transcriptional initiation. Typically, these are located in the region 30-110 bp upstream of the start site, although a number of promoters have recently been shown to contain functional elements downstream of the start site as well. The spacing between promoter elements frequently is flexible, so that promoter function is preserved when elements are inverted or moved relative to one another. In the thymidine kinase (tk) promoter, the spacing between promoter elements can be increased to 50 bp apart before activity begins to decline. Depending on the promoter, it appears that individual elements can function either cooperatively or independently to activate transcription.

Various promoter sequences may be used, including, but not limited to the immediate early cytomegalovirus (CMV) promoter, the CMV-actin-globin hybrid (CAG) promotor, Elongation Growth Factor-1α (EF-1α), simian virus 40 (SV40) early promoter, mouse mammary tumor virus (MMTV), human immunodeficiency virus (HIV) long terminal repeat (LTR) promoter, MoMuLV promoter, an avian leukemia virus promoter, an Epstein-Barr virus immediate early promoter, a Rous sarcoma virus promoter, as well as human gene promoters such as, but not limited to, the actin promoter, the myosin promoter, the hemoglobin promoter, and the creatine kinase promoter. Further, the invention should not be limited to the use of constitutive promoters.

Inducible promoters are also contemplated as part of the invention. The use of an inducible promoter provides a molecular switch capable of turning on expression of the polynucleotide sequence which it is operatively linked when such expression is desired, or turning off the expression when expression is not desired. Examples of inducible promoters include, but are not limited to a metallothionine promoter, a glucocorticoid promoter, a progesterone promoter, and a tetracycline promoter.

In order to assess the expression of a CAR polypeptide or portions thereof, the expression vector to be introduced into a cell can also contain either a selectable marker gene or a reporter gene or both to facilitate identification and selection of expressing cells from the population of cells sought to be transfected or infected through viral vectors. In other aspects, the selectable marker may be carried on a separate piece of DNA and used in a co-transfection procedure. Both selectable markers and reporter genes may be flanked with appropriate regulatory sequences to enable expression in the host cells. Useful selectable markers include, for example, antibiotic-resistance genes, such as neo and the like.

In a preferred embodiment, the selectable marker gene comprises a nucleic acid sequence encoding truncated CD19 (trCD19).

Reporter genes are used for identifying potentially transfected cells and for evaluating the functionality of regulatory sequences. In general, a reporter gene is a gene that is not present in or expressed by the recipient organism or tissue and that encodes a polypeptide whose expression is manifested by some easily detectable property, e.g., enzymatic activity. Expression of the reporter gene is assayed at a suitable time after the DNA has been introduced into the recipient cells. Suitable reporter genes may include genes encoding luciferase, β-galactosidase, chloramphenicol acetyl transferase, secreted alkaline phosphatase, or the green fluorescent protein gene (e.g., Ui-Tei et al., 2000 *FEBS Letters* 479: 79-82). Suitable expression systems are well known and may be prepared using known techniques or obtained commercially. In general, the construct with the minimal 5' flanking region showing the highest level of expression of reporter gene is identified as the promoter. Such promoter regions may be linked to a reporter gene and used to evaluate agents for the ability to modulate promoter-driven transcription.

Transduction

Methods of introducing and expressing genes into a cell are known in the art. In the context of an expression vector, the vector can be readily introduced into a host cell, e.g., mammalian, bacterial, yeast, or insect cell by any method in the art. For example, the expression vector can be transferred into a host cell by physical, chemical, or biological means.

A flow chart illustrating a potential method for manufacturing isolated CAR-expressing cells is provided in FIG. 8.

Physical methods for introducing a polynucleotide into a host cell include calcium phosphate precipitation, lipofection, particle bombardment, microinjection, electroporation, and the like. Methods for producing cells comprising vectors and/or exogenous nucleic acids are well-known in the art. See, for example, Sambrook et al. (2001, Molecular Cloning: A Laboratory Manual, Cold Spring Harbor Laboratory, New York). A preferred method for the introduction of a polynucleotide into a host cell is calcium phosphate transfection.

Biological methods for introducing a polynucleotide of interest into a host cell include the use of DNA and RNA vectors. Viral vectors, and especially retroviral vectors, have become the most widely used method for inserting genes into mammalian, e.g., human cells. Other viral vectors can be derived from lentivirus, poxviruses, herpes simplex virus I, adenoviruses and adeno-associated viruses, and the like. See, for example, U.S. Pat. Nos. 5,350,674 and 5,585,362.

Chemical means for introducing a polynucleotide into a host cell include colloidal dispersion systems, such as macromolecule complexes, nanocapsules, microspheres, beads, and lipid-based systems including oil-in-water emulsions, micelles, mixed micelles, and liposomes. An exemplary colloidal system for use as a delivery vehicle in vitro and in vivo is a liposome (e.g., an artificial membrane vesicle).

In the case where a non-viral delivery system is utilized, an exemplary delivery vehicle is a liposome. The use of lipid formulations is contemplated for the introduction of the nucleic acids into a host cell (in vitro, ex vivo or in vivo). In another aspect, the nucleic acid may be associated with a lipid. The nucleic acid associated with a lipid may be encapsulated in the aqueous interior of a liposome, interspersed within the lipid bilayer of a liposome, attached to a liposome via a linking molecule that is associated with both the liposome and the oligonucleotide, entrapped in a liposome, complexed with a liposome, dispersed in a solution containing a lipid, mixed with a lipid, combined with a lipid, contained as a suspension in a lipid, contained or complexed with a micelle, or otherwise associated with a lipid. Lipid, lipid/DNA or lipid/expression vector associated compositions are not limited to any particular structure in solution. For example, they may be present in a bilayer structure, as micelles, or with a "collapsed" structure. They may also simply be interspersed in a solution, possibly forming aggregates that are not uniform in size or shape. Lipids are fatty substances which may be naturally occurring or synthetic lipids. For example, lipids include the fatty droplets that naturally occur in the cytoplasm as well as the class of compounds which contain long-chain aliphatic hydrocarbons and their derivatives, such as fatty acids, alcohols, amines, amino alcohols, and aldehydes.

Lipids suitable for use can be obtained from commercial sources. For example, dimyristyl phosphatidylcholine ("DMPC") can be obtained from Sigma, St. Louis, Mo.; dicetyl phosphate ("DCP") can be obtained from K & K Laboratories (Plainview, N.Y.); cholesterol ("Choi") can be obtained from Calbiochem-Behring; dimyristyl phosphatidylglycerol ("DMPG") and other lipids may be obtained from Avanti Polar Lipids, Inc. (Birmingham, Ala.). Stock solutions of lipids in chloroform or chloroform/methanol can be stored at about −20 degrees Celsius (−20° C.). Chloroform is used as the only solvent since it is more readily evaporated than methanol. "Liposome" is a generic term encompassing a variety of single and multilamellar lipid vehicles formed by the generation of enclosed lipid bilayers or aggregates. Liposomes can be characterized as having vesicular structures with a phospholipid bilayer membrane and an inner aqueous medium. Multilamellar liposomes have multiple lipid layers separated by aqueous medium. They form spontaneously when phospholipids are suspended in an excess of aqueous solution. The lipid components undergo self-rearrangement before the formation of closed structures and entrap water and dissolved solutes between the lipid bilayers (Ghosh et al., "1991 *Glycobiology* 5: 505-10). However, compositions that have different structures in solution than the normal vesicular structure are also encompassed. For example, the lipids may assume a micellar structure or merely exist as nonuniform aggregates of lipid molecules. Also contemplated are lipofectamine-nucleic acid complexes.

Regardless of the method used to introduce exogenous nucleic acids into a host cell or otherwise expose a cell to the inhibitor of the present invention, in order to confirm the presence of the recombinant DNA sequence in the host cell, a variety of assays may be performed. Such assays include, for example, "molecular biological" assays well known to those of skill in the art, such as Southern and Northern blotting, RT-PCR and PCR; "biochemical" assays, such as detecting the presence or absence of a particular peptide, e.g., by immunological means (ELISAs and Western blots) or by assays described herein to identify agents falling within the scope of the invention.

Cells

Also provided are cells, cell populations, and compositions containing the cells, e.g., cells comprising a nucleic acid sequence encoding a CAR of the present invention. Cells comprising a nucleic acid sequence encoding a CAR of the present invention, further engineered to comprise an exogenous nucleic sequence encoding an anti-fibrotic or immuno-modulatory molecule are also provided. Among the compositions are pharmaceutical compositions and formulations for administration, such as for adoptive cell therapy. Also provided are therapeutic methods for administering the cells and compositions to subjects, e.g., patients.

Cell Types

Thus also provided are cells expressing the CARs against a molecule expressed in a fibrotic setting or expressed on disease-associated macrophages (DAMs), The cells generally are eukaryotic cells, such as mammalian cells, and typically are human cells, more typically primary human cells, e.g., allogeneic or autologous donor cells. The cells for introduction of the CAR may be isolated from a sample, such as a biological sample, e.g., one obtained from or derived from a subject. In some embodiments, the subject from which the cell is isolated is one having the disease or condition or in need of a cell therapy or to which cell therapy will be administered. The subject in some embodiments is a human in need of a particular therapeutic intervention, such as the adoptive cell therapy for which cells are being isolated, processed, and/or engineered. In some embodiments, the cells are derived from the blood, bone marrow, lymph, or lymphoid organs, are cells of the immune system, such as cells of the innate or adaptive immunity, e.g., myeloid or lymphoid cells, including lymphocytes, typically T cells and/or NK cells. Other exemplary cells include stem cells, such as multipotent and pluripotent stem cells, including induced pluripotent stem cells (iPSCs). The cells typically are primary cells, such as those isolated directly from a subject and/or isolated from a subject and frozen. In some embodiments, the cells include one or more subsets of T cells or other cell types, such as whole T cell populations, $CD4^+$ cells, $CD8^+$ cells, and subpopulations thereof, such as those defined by function, activation state, maturity, potential for differentiation, expansion, recirculation, localization, and/or persistence capacities, antigen-specificity, type of antigen receptor, presence in a particular organ or compartment, marker or cytokine secretion profile, and/or degree of differentiation.

With reference to the subject to be treated, the cells may be allogeneic and/or autologous. Among the methods include off-the-shelf methods. In some aspects, such as for off-the-shelf technologies, the cells are pluripotent and/or multipotent, such as stem cells, such as induced pluripotent stem cells (iPSCs). In some embodiments, the methods include isolating cells from the subject, preparing, processing, culturing, and/or engineering them, as described herein, and re-introducing them into the same patient, before or after cryopreservation.

Among the sub-types and subpopulations of T cells and/or of $CD4^+$ and/or of $CD8^+$ T cells are naive T (TN) cells, effector T cells (TEFF), memory T cells and sub-types thereof, such as stem cell memory T (TSCM), central memory T (TCM), effector memory T (TEM), or terminally differentiated effector memory T cells, tumor-infiltrating lymphocytes (TIL), immature T cells, mature T cells, helper T cells, cytotoxic T cells, mucosa-associated invariant T (MAIT) cells, naturally occurring and adaptive regulatory T (Treg) cells, helper T cells, such as TH1 cells, TH2 cells, TH3 cells, TH17 cells, TH9 cells, TH22 cells, follicular helper T cells, $\alpha/\beta$ cells, and $\delta/\gamma$ T cells.

In some embodiments, the cells are natural killer (NK) cells, Natural Killer T (NKT) cells, cytokine-induced killer (CIK) cells, tumor-infiltrating lymphocytes (TIL), lymphokine-activated killer (LAK) cells, or the like. In some embodiments, the cells are monocytes or granulocytes, e.g., myeloid cells, macrophages, neutrophils, dendritic cells, mast cells, eosinophils, and/or basophils.

In some embodiments, the cells are derived from cell lines, e.g., T cell lines. The cells in some embodiments are obtained from a xenogeneic source, for example, from mouse, rat, non-human primate, and pig.

Cell Acquisition

Prior to expansion and genetic modification, a source of cells can be obtained from a subject through a variety of non-limiting methods. Cells can be obtained from a number of non-limiting sources, including peripheral blood mononuclear cells, bone marrow, lymph node tissue, cord blood, thymus tissue, tissue from a site of infection, ascites, pleural effusion, spleen tissue, and disease sites such as the fibrotic sites or tumors. In some embodiments, any number of T cell lines available and known to those skilled in the art, may be used. In some embodiments, cells can be derived from a healthy donor, from a patient diagnosed with cancer or from a patient diagnosed with an infection. In some embodiments, cells can be part of a mixed population of cells which present different phenotypic characteristics.

Accordingly, the cells in some embodiments are primary cells, e.g., primary human cells. The samples include tissue, fluid, and other samples taken directly from the subject, as well as samples resulting from one or more processing steps, such as separation, centrifugation, genetic engineering (e.g. transduction with viral vector), washing, and/or incubation. The biological sample can be a sample obtained directly from a biological source or a sample that is processed. Biological samples include, but are not limited to, body fluids, such as blood, plasma, serum, cerebrospinal fluid, synovial fluid, urine and sweat, tissue and organ samples, including processed samples derived therefrom.

In some aspects, the sample from which the cells are derived or isolated is blood or a blood-derived sample, or is or is derived from an apheresis or leukapheresis product. Exemplary samples include whole blood, peripheral blood mononuclear cells (PBMCs), leukocytes, bone marrow, thymus, tissue biopsy, fibrotic tissue, tumor, leukemia, lymphoma, lymph node, gut associated lymphoid tissue, mucosa associated lymphoid tissue, spleen, other lymphoid tissues, liver, lung, stomach, intestine, colon, kidney, pancreas, breast, bone, prostate, cervix, testes, ovaries, tonsil, or other organ, and/or cells derived therefrom. Samples include, in the context of cell therapy, e.g., adoptive cell therapy, samples from autologous and allogeneic sources.

In some examples, cells from the circulating blood of a subject are obtained, e.g., by apheresis or leukapheresis. The samples, in some aspects, contain lymphocytes, including T cells, monocytes, granulocytes, B cells, other nucleated white blood cells, red blood cells, and/or platelets, and in some aspects contains cells other than red blood cells and platelets.

Also provided herein are cell lines obtained from a transformed cell according to any of the above-described methods. Also provided herein are modified cells resistant to an immunosuppressive treatment. In some embodiments, an isolated cell according to the invention comprises a polynucleotide encoding a CAR.

Cell Purification

In some embodiments, isolation of the cells includes one or more preparation and/or non-affinity based cell separation steps. In some examples, cells are washed, centrifuged, and/or incubated in the presence of one or more reagents, for example, to remove unwanted components, enrich for desired components, lyse or remove cells sensitive to particular reagents. In some examples, cells are separated based on one or more property, such as density, adherent properties, size, sensitivity and/or resistance to particular components.

In some embodiments, the blood cells collected from the subject are washed, e.g., to remove the plasma fraction and to place the cells in an appropriate buffer or media for subsequent processing steps. In some embodiments, the cells are washed with phosphate buffered saline (PBS). In some embodiments, the wash solution lacks calcium and/or magnesium and/or many or all divalent cations. In some aspects, a washing step is accomplished a semi-automated "flow-through" centrifuge (for example, the Cobe 2991 cell processor, Baxter) according to the manufacturer's instructions. In some aspects, a washing step is accomplished by tangential flow filtration (TFF) according to the manufacturer's instructions. In some embodiments, the cells are resuspended in a variety of biocompatible buffers after washing, such as, for example, $Ca^{++}/Mg^{++}$ free PBS. In certain embodiments, components of a blood cell sample are removed and the cells directly resuspended in culture media.

In some embodiments, the isolation methods include the separation of different cell types based on the expression or presence in the cell of one or more specific molecules, such as surface markers, e.g., surface proteins, intracellular markers, or nucleic acid. In a specific embodiment, the surface maker is trCD19. In some embodiments, any known method for separation based on such markers may be used. In some embodiments, the separation is affinity- or immunoaffinity-based separation. For example, the isolation in some aspects includes separation of cells and cell populations based on the cells' expression or expression level of one or more markers, typically cell surface markers, for example, by incubation with an antibody or binding partner that specifically binds to such markers, followed generally by washing steps and separation of cells having bound the antibody or binding partner, from those cells having not bound to the antibody or binding partner.

Such separation steps can be based on positive selection, in which the cells having bound the reagents are retained for further use, and/or negative selection, in which the cells having not bound to the antibody or binding partner are retained. In some examples, both fractions are retained for further use. In some aspects, negative selection can be particularly useful where no antibody is available that specifically identifies a cell type in a heterogeneous population, such that separation is best carried out based on markers expressed by cells other than the desired population.

In some embodiments, multiple rounds of separation steps are carried out, where the positively or negatively selected fraction from one step is subjected to another separation step, such as a subsequent positive or negative selection. In some examples, a single separation step can deplete cells expressing multiple markers simultaneously, such as by incubating cells with a plurality of antibodies or binding partners, each specific for a marker targeted for negative selection. Likewise, multiple cell types can simultaneously be positively selected by incubating cells with a plurality of antibodies or binding partners expressed on the various cell types.

For example, in some aspects, specific subpopulations of T cells, such as cells positive or expressing high levels of one or more surface markers, e.g., $CD28^+$, $CD62L^+$, $CCR7^+$, $CD27^+$, $CD127^+$, $CD4^+$, $CD8^+$, $CD45^{RA+}$ and/or $CD45^{RO+}$ T cells, are isolated by positive or negative selection techniques. For example, $CD3^+$ T cells can be positively selected using CD3 conjugated magnetic beads (e.g., DYNABEADS® M-450 CD3/CD28 T Cell Expander).

In some embodiments, isolation is carried out by enrichment for a particular cell population by positive selection, or depletion of a particular cell population, by negative selection. In some embodiments, positive or negative selection is accomplished by incubating cells with one or more antibodies or other binding agent that specifically bind to one or more surface markers expressed or expressed (marker+) at a relatively higher level ($marker^{high}$) on the positively or negatively selected cells, respectively.

In some embodiments, T cells are separated from a PBMC sample by negative selection of markers expressed on non-T cells, such as B cells, monocytes, or other white blood cells, such as CD14. In some aspects, a $CD4^+$ or $CD8^+$ selection step is used to separate $CD4^+$ helper and $CD8^+$ cytotoxic T cells. Such $CD4^+$ and $CD8^+$ populations can be further sorted into sub-populations by positive or negative selection for markers expressed or expressed to a relatively higher degree on one or more naive, memory, and/or effector T cell subpopulations.

In some embodiments, $CD8^+$ cells are further enriched for or depleted of naive, central memory, effector memory, and/or central memory stem cells, such as by positive or negative selection based on surface antigens associated with the respective subpopulation. In some embodiments, enrichment for central memory T ($T_{CM}$) cells is carried out to increase efficacy, such as to improve long-term survival, expansion, and/or engraftment following administration, which in some aspects is particularly robust in such subpopulations. See Terakura et al. (2012) *Blood.* 1:72-82; Wang et al. (2012) *J Immunother.* 35(9):689-701. In some embodiments, combining $T_{CM}$-enriched $CD8^+$ T cells and $CD4^+$ T cells further enhances efficacy. In embodiments, memory T cells are present in both $CD62L^+$ and $CD62L^-$ subsets of $CD8^+$ peripheral blood lymphocytes. PBMC can be enriched for or depleted of $CD62L^-CD8^+$ and/or $CD62L^+$ CD8 fractions, such as using anti-CD8 and anti-CD62L antibodies.

In some embodiments, the enrichment for central memory T ($T_{CM}$) cells is based on positive or high surface expression of CD45RO, CD62L, CCR7, CD28, CD3, and/or CD127; in some aspects, it is based on negative selection for cells expressing or highly expressing CD45RA and/or granzyme B. In some aspects, isolation of a $CD8^+$ population enriched for $T_{CM}$ cells is carried out by depletion of cells expressing CD4, CD14, CD45RA, and positive selection or enrichment for cells expressing CD62L. In one aspect, enrichment for central memory T ($T_{CM}$) cells is carried out starting with a negative fraction of cells selected based on CD4 expression, which is subjected to a negative selection based on expression of CD14 and CD45RA, and a positive selection based on CD62L. Such selections in some aspects are carried out simultaneously and in other aspects are carried out sequentially, in either order. In some aspects, the same CD4 expression-based selection step used in preparing the $CD8^+$ cell population or subpopulation, also is used to generate the $CD4^+$ cell population or subpopulation, such that both the positive and negative fractions from the CD4-based separation are retained and used in subsequent steps of the methods, optionally following one or more further positive or negative selection steps.

In some aspects, the sample or composition of cells to be separated is incubated with small, magnetizable or magnetically responsive material, such as magnetically responsive particles or microparticles, such as paramagnetic beads (e.g., such as Dynalbeads or MACS beads). The magnetically responsive material, e.g., particle, generally is directly or indirectly attached to a binding partner, e.g., an antibody, that specifically binds to a molecule, e.g., surface marker, present on the cell, cells, or population of cells that it is desired to separate, e.g., that it is desired to negatively or positively select.

In some embodiments, the magnetic particle or bead comprises a magnetically responsive material bound to a specific binding member, such as an antibody or other binding partner. There are many well-known magnetically responsive materials used in magnetic separation methods. Suitable magnetic particles include those described in Molday, U.S. Pat. No. 4,452,773, and in European Patent Specification EP 452342 B, which are hereby incorporated by reference. Colloidal sized particles, such as those described in Owen U.S. Pat. No. 4,795,698, and Liberti et al., U.S. Pat. No. 5,200,084 are other examples.

The incubation generally is carried out under conditions whereby the antibodies or binding partners, or molecules, such as secondary antibodies or other reagents, which specifically bind to such antibodies or binding partners, which are attached to the magnetic particle or bead, specifically bind to cell surface molecules if present on cells within the sample.

In some aspects, the sample is placed in a magnetic field, and those cells having magnetically responsive or magnetizable particles attached thereto will be attracted to the magnet and separated from the unlabeled cells. For positive selection, cells that are attracted to the magnet are retained; for negative selection, cells that are not attracted (unlabeled cells) are retained. In some aspects, a combination of positive and negative selection is performed during the same selection step, where the positive and negative fractions are retained and further processed or subject to further separation steps.

In certain embodiments, the magnetically responsive particles are coated in primary antibodies or other binding partners, secondary antibodies, lectins, enzymes, or streptavidin. In certain embodiments, the magnetic particles are attached to cells via a coating of primary antibodies specific for one or more markers. In certain embodiments, the cells, rather than the beads, are labeled with a primary antibody or binding partner, and then cell-type specific secondary antibody- or other binding partner (e.g., streptavidin)-coated magnetic particles, are added. In certain embodiments, streptavidin-coated magnetic particles are used in conjunction with biotinylated primary or secondary antibodies.

In some embodiments, the magnetically responsive particles are left attached to the cells that are to be subsequently incubated, cultured and/or engineered; in some aspects, the particles are left attached to the cells for administration to a patient. In some embodiments, the magnetizable or magnetically responsive particles are removed from the cells. Methods for removing magnetizable particles from cells are known and include, e.g., the use of competing non-labeled antibodies, magnetizable particles or antibodies conjugated to cleavable linkers, etc. In some embodiments, the magnetizable particles are biodegradable.

In certain embodiments, the isolation or separation is carried out using a system, device, or apparatus that carries out one or more of the isolation, cell preparation, separation, processing, incubation, culture, and/or formulation steps of the methods. In some aspects, the system is used to carry out each of these steps in a closed or sterile environment, for example, to minimize error, user handling and/or contamination. In one example, the system is a system as described in International Patent Application, Publication Number WO2009/072003, or US 20110003380 A1.

In some embodiments, the system or apparatus carries out one or more, e.g., all, of the isolation, processing, engineering, and formulation steps in an integrated or self-contained system, and/or in an automated or programmable fashion. In some aspects, the system or apparatus includes a computer and/or computer program in communication with the system or apparatus, which allows a user to program, control, assess the outcome of, and/or adjust various aspects of the processing, isolation, engineering, and formulation steps.

In some embodiments, a cell population described herein is collected and enriched (or depleted) via flow cytometry, in which cells stained for multiple cell surface markers are carried in a fluidic stream. In some embodiments, a cell population described herein is collected and enriched (or depleted) via preparative scale (FACS)-sorting. In certain embodiments, a cell population described herein is collected and enriched (or depleted) by use of microelectromechanical systems (MEMS) chips in combination with a FACS-based detection system (see, e.g., WO 2010/033140, Cho et al. (2010) *Lab Chip* 10, 1567-1573; and Godin et al. (2008) *J Biophoton.* 1(5):355-376. In both cases, cells can be labeled with multiple markers, allowing for the isolation of well-defined T cell subsets at high purity.

In some embodiments, the antibodies or binding partners are labeled with one or more detectable marker, to facilitate separation for positive and/or negative selection. For example, separation may be based on binding to fluorescently labeled antibodies. In some examples, separation of cells based on binding of antibodies or other binding partners specific for one or more cell surface markers are carried in a fluidic stream, such as by fluorescence-activated cell sorting (FACS), including preparative scale (FACS) and/or microelectromechanical systems (MEMS) chips, e.g., in combination with a flow-cytometric detection system. Such methods allow for positive and negative selection based on multiple markers simultaneously.

In some embodiments, the methods include density-based cell separation methods, such as the preparation of white blood cells from peripheral blood by lysing the red blood cells and centrifugation through a Percoll or Ficoll gradient.

In any of the aforementioned separation steps, the separation need not result in 100% enrichment or removal of a particular cell population or cells expressing a particular marker. For example, positive selection of or enrichment for cells of a particular type, such as those expressing a marker, refers to increasing the number or percentage of such cells, but need not result in a complete absence of cells not expressing the marker. Likewise, negative selection, removal, or depletion of cells of a particular type, such as those expressing a marker, refers to decreasing the number or percentage of such cells, but need not result in a complete removal of all such cells.

Cell Preparation and Expansion

In some embodiments, the provided methods include cultivation, incubation, culture, and/or genetic engineering steps. For example, in some embodiments, provided are methods for incubating and/or engineering the depleted cell populations and culture-initiating compositions.

Thus, in some embodiments, the cell populations are incubated in a culture-initiating composition. The incubation and/or engineering may be carried out in a culture vessel, such as a unit, chamber, well, column, tube, tubing set, valve, vial, culture dish, bag, or other container for culture or cultivating cells.

In some embodiments, the cells are incubated and/or cultured prior to or in connection with genetic engineering. The incubation steps can include culture, cultivation, stimulation, activation, and/dr propagation.

In some embodiments, the compositions or cells are incubated in the presence of stimulating conditions or a stimulatory agent. Such conditions include those designed to induce proliferation, expansion, activation, and/or survival of cells in the population, to mimic antigen exposure, and/or to prime the cells for genetic engineering, such as for the introduction of a recombinant antigen receptor. The cells of the invention can be activated and expanded, either prior to or after genetic modification of the cells, using methods as generally described, for example without limitation, in U.S. Pat. Nos. 6,352,694; 6,534,055; 6,905,680; 6,692,964; 5,858,358; 6,887,466; 6,905,681; 7,144,575; 7,067,318; 7,172,869; 7,232,566; 7,175,843; 5,883,223; 6,905,874; 6,797,514; 6,867,041; and U.S. Patent Application Publication No. 20060121005. The conditions can include one or more of particular media, temperature, oxygen content, carbon dioxide content, time, agents, e.g., nutrients, amino acids, antibiotics, ions, and/or stimulatory factors, such as cytokines, chemokines, antigens, binding partners, fusion proteins, recombinant soluble receptors, and any other agents designed to activate the cells.

T cells can be expanded in vitro or in vivo. Generally, the T cells of the invention can be expanded, for example, by contact with an agent that stimulates a CD3 TCR complex and a co-stimulatory molecule on the surface of the T cells to create an activation signal for the T cell. For example, chemicals such as calcium ionophore A23187, phorbol 12-myristate 13-acetate (PMA), or mitogenic lectins like phytohemagglutinin (PHA) can be used to create an activation signal for the T cell.

In some embodiments, T cell populations may be stimulated in vitro by contact with, for example, an anti-CD3 antibody, or antigen-binding fragment thereof, or an anti-CD2 antibody immobilized on a surface, or by contact with a protein kinase C activator (e.g., bryostatin) in conjunction with a calcium ionophore. In some embodiments, the T cell populations may be stimulated in vitro by contact with Muromonab-CD3 (OKT3). For co-stimulation of an accessory molecule on the surface of the T cells, a ligand that binds the accessory molecule is used. For example, a population of T cells can be contacted with an anti-CD3 antibody and an anti-CD28 antibody, under conditions appropriate for stimulating proliferation of the T cells. Conditions appropriate for T cell culture include an appropriate media (e.g., Minimal Essential Media or RPMI Media 1640 or, X-vivo 5®, (Lonza)) that may contain factors necessary for proliferation and viability, including serum (e.g., fetal bovine or human serum), interleukin-2 (IL-2), insulin, IFN-γ, IL-4, IL-7, GM-CSF, IL-10, IL-2, IL-15, IL-21, TGF-β, and TNF, or any other additives for the growth of cells known to the skilled artisan. In a preferred embodiment, T cells are stimulated in vitro by exposure to OKT3 and IL-2. Other additives for the growth of cells include, but are not limited to, surfactant, Plasmanate, and reducing agents such as N-acetyl-cysteine and 2-mercaptoethanol. Media can include RPMI 1640®, A1M-V, DMEM, MEM, a-MEM, F-12, X-Vivo 1®, and X-Vivo 20®, Optimizer, with added amino acids, sodium pyruvate, and vitamins, either serum-free or supplemented with an appropriate amount of serum (or plasma) or a defined set of hormones, and/or an amount of cytokine(s) sufficient for the growth and expansion of T cells. Antibiotics, e.g., penicillin and streptomycin, are included only in experimental cultures, not in cultures of cells that are to be infused into a subject. The target cells are maintained under conditions necessary to support growth, for example, an appropriate temperature (e.g., 37° Celsius) and atmosphere (e.g., air plus 5% $CO_2$). T cells that have been exposed to varied stimulation times may exhibit different characteristics.

In some embodiments, the isolated cells of the invention can be expanded by co-culturing with tissue or cells. The cells can also be expanded in vivo, for example in the subject's blood after administrating the cell into the subject.

In some embodiments, the T cells are expanded by adding to the culture-initiating composition feeder cells, such as non-dividing peripheral blood mononuclear cells (PBMC), (e.g., such that the resulting population of cells contains at least about 5, 10, 20, or 40 or more PBMC feeder cells for each T lymphocyte in the initial population to be expanded); and incubating the culture (e.g. for a time sufficient to expand the numbers of T cells). In some aspects, the non-dividing feeder cells can comprise γ-irradiated PBMC feeder cells. In some embodiments, the PBMC are irradiated with γ rays in the range of about 3000 to 3600 rads to prevent cell division. In some aspects, the feeder cells are added to culture medium prior to the addition of the populations of T cells.

In some embodiments, the preparation methods include steps for freezing, e.g., cryopreserving, the cells, either before or after isolation, incubation, and/or engineering. In some embodiments, the freeze and subsequent thaw step removes granulocytes and, to some extent, monocytes in the cell population. In some embodiments, the cells are suspended in a freezing solution, e.g., following a washing step to remove plasma and platelets. Any of a variety of known freezing solutions and parameters in some aspects may be used. One example involves using PBS containing 20% DMSO and 8% human serum albumin (HSA), or other suitable cell freezing media. This is then diluted 1:1 with media so that the final concentration of DMSO and HSA are 10% and 4%, respectively. The cells are then frozen to −80° Celsius at a rate of 1 degree per minute and stored in the vapor phase of a liquid nitrogen storage tank.

Therapeutic Applications

Isolated cells obtained by the methods described above, or cell lines derived from such isolated cells, can be used as a medicament in the treatment of a disease, disorder, or condition in a subject. In some embodiments, such a medicament can be used for treating a DAM-associated condition, a fibrotic condition, an inflammatory condition, or an autoimmune condition.

Cell Origin

For purposes of the inventive methods, wherein host cells or populations of cells are administered, the cells can be cells that are xenogeneic, allogeneic or autologous to the subject. Generally, the cells are autologous to the subject.

In some embodiments, the cell therapy, e.g., adoptive cell therapy, e.g., adoptive T cell therapy, is carried out by autologous transfer, in which the cells are isolated and/or otherwise prepared from the subject who is to receive the cell therapy, or from a sample derived from such a subject. Thus, in some aspects, the cells are derived from a subject, e.g., patient, in need of a treatment and the cells, following isolation and processing are administered to the same subject.

In some embodiments, the cell therapy, e.g., adoptive cell therapy, e.g., adoptive T cell therapy, is carried out by allogeneic transfer, in which the cells are isolated and/or otherwise prepared from a subject other than a subject who is to receive or who ultimately receives the cell therapy, e.g., a first subject. In such embodiments, the cells then are administered to a different subject, e.g., a second subject, of the same species. In some embodiments, the first and second subjects are genetically identical. In some embodiments, the first and second subjects are genetically similar. In some embodiments, the second subject expresses the same HLA class or supertype as the first subject.

Subject

The subject referred to herein may be any living subject. In a preferred embodiment, the subject is a mammal. The mammal referred to herein can be any mammal. As used herein, the term "mammal" refers to any mammal, including, but not limited to, mammals of the order Rodentia, such as mice and hamsters, and mammals of the order Logomorpha, such as rabbits. The mammals may be from the order Carnivora, including Felines (cats) and Canines (dogs). The mammals may be from the order Artiodactyla, including Bovines (cows) and Swines (pigs) or of the order Perssodactyla, including Equines (horses). The mammals may be of the order Primates, Ceboids, or Simoids (monkeys) or of the order Anthropoids (humans and apes).

In some embodiments, the subject, to whom the cells, cell populations, or compositions are administered is a primate, such as a human. In some embodiments, the primate is a monkey or an ape. The subject can be male or female and can be any suitable age, including infant, juvenile, adolescent, adult, and geriatric subjects. In some examples, the patient or subject is a validated animal model for disease, adoptive cell therapy, and/or for assessing toxic outcomes such as cytokine release syndrome (CRS).

In some embodiments, the subject has persistent or relapsed disease, e.g., following treatment with another immunotherapy and/or other therapy. In some embodiments, the administration effectively treats the subject despite the subject having become resistant to another therapy. In some embodiments, the subject has not relapsed but is determined to be at risk for relapse, such as at a high risk of relapse, and thus the compound or composition is administered prophylactically, e.g., to reduce the likelihood of or prevent relapse.

In some embodiments, the methods include administration of CAR expressing cells or a composition containing the cells to a subject, tissue, or cell, such as one having, at risk for, or suspected of having a disease, condition or disorder associated with DAMs, a fibrotic condition or an inflammatory condition, or an autoimmune condition. In some embodiments, the cells, populations, and compositions are administered to a subject having the particular disease or condition to be treated, e.g., via adoptive cell therapy, such as adoptive T cell therapy. In some embodiments, the cells or compositions are administered to the subject, such as a subject having or at risk for the disease or condition. In some aspects, the methods thereby treat, e.g., ameliorate one or more symptom of the disease or condition, such as by reducing, inhibiting, or inactivating DAMs, by reducing the fibrotic microenvironment, or by reducing inflammation.

Functional Activity

In one embodiment, the present invention includes a type of cellular therapy where isolated cells are genetically modified to express a CAR against a molecule which is expressed on DAMs or which is over- or aberrantly-expressed in fibrosis, and the CAR cell is infused into a subject in need thereof. Examples of such a target molecule include CD206, CD163, and Fn14. Such administration can promote activation of the cells (e.g., T cell activation) in a target molecule specific manner, such that the cells of the disease or disorder are targeted for destruction. In the case where the cell is a T cell, CAR T cells, unlike antibody therapies, are able to replicate in vivo resulting in long-term persistence that may lead to sustained control of diseases, disorders, or conditions associated with DAMs, fibrotic conditions, inflammatory conditions, or autoimmune conditions.

In one embodiment, the isolated cells of the invention can undergo in vivo expansion and can persist for an extended amount of time. In another embodiment, where the isolated cell is a T cell, the isolated T cells of the invention evolve into specific memory T cells that can be reactivated to inhibit growth of any additional target molecule expressing cells. CAR T cells may differentiate in vivo into a central memory-like state upon encounter and subsequent elimination of target cells expressing the surrogate antigen.

Without wishing to be bound by any particular theory, the immune response elicited by the isolated CAR-modified immune cells may be an active or a passive immune response. In addition, the CAR mediated immune response may be part of an adoptive immunotherapy approach in which CAR-modified immune cells induce an immune response specific to the antigen binding domain in the CAR.

In certain embodiments, CAR expressing cells are modified in any number of ways, such that their therapeutic or prophylactic efficacy is increased. For example, the CAR may be conjugated either directly or indirectly through a linker to a targeting moiety. The practice of conjugating compounds, e.g., the CAR, to targeting moieties is known in the art. See, for instance, Wadwa et al., *J. Drug Targeting* 3: 111 (1995), and U.S. Pat. No. 5,087,616.

Once the cells are administered to a subject (e.g., a human), the biological activity of the engineered cell populations and/or antibodies in some aspects is measured by any of a number of known methods. Parameters to assess include specific binding of an engineered or natural T cell or other immune cell to antigen, in vivo, e.g., by imaging, or ex vivo, e.g., by ELISA or flow cytometry. In certain embodiments, the ability of the engineered cells to destroy target cells can be measured using any suitable method known in the art, such as cytotoxicity assays described in, for example, Kochenderfer et al., *J. Immunotherapy,* 32(7): 689-702 (2009), and Herman et al. *J. Immunological Methods,* 285 (1): 25-40 (2004). In certain embodiments, the biological activity of the cells also can be measured by assaying expression and/or secretion of certain mediators, such as GM-CSF, IL-6, RANTES (CCL5), TNF-α, IL-4, IL-10, IL-13, IFN-γ, granzyme B, perforin, CD 107a, or IL-2.

In some aspects the biological activity is measured by assessing clinical outcome, such as the reduction in disease symptoms. In case of fibrosis, the reduced thickness of the fibrotic tissue may be one indication. For example in SSc, skin thickness may be assessed. In case of autoimmune diseases, decrease in autoreactive T cells, B cells, or Abs and reduced inflammation may represent successful biological activity. In case of cancer, improved efficacy may be shown by better infiltration of disease-resolving immune cells into the tumor, reduced tumor sizes, or reduced ascites. In some embodiments, gene expression profiles may be also investigated to evaluate the activity.

Target Cells

Cells that may be targeted by a CAR of present invention include DAMs, cells associated with a fibrotic disease (such as a fibroblast or epithelial cell), and cells associated with an inflammatory disease. The DAMs may also be referred to in the art as alternatively activated MPs, M2 MPs, M2-like MPs, M2a MPs, M2b MPs, M2c MPs, M4 MPs, fibrotic MPs, pro-fibrotic MPs, or tumor-associated MPs (TAMs), depending on the context, function, and phenotype (Murray, P., and Wynn, T. A., "Protective and pathogenic functions of macrophage subsets", *Nat Rev Immunol.* 2011 Oct. 14; 11(11): p. 723-37; Chinetti-Gbaguidi, G., Colin, S., and Staels, B., "Macrophage subsets in atherosclerosis", *Nat Rev Cardiol.* 2015 January; 12(1): p. 10-7). The target cell may be present in any part of the body of a subject, including blood or lymphatic circulation, and disease-affected tissues. For example, when the target disease is SSc, the disease-affected tissues include, but are not limited to, peripheral blood, skin, lung, esophagus, stomach, and duodenum, and target cells may be DAMs, fibroblasts, and/or epithelial cells.

Preferably, the CAR-expressing cells of the invention are used to treat a fibrotic or an inflammatory disease, wherein DAMs or fibrotic fibroblasts or epithelial cells have surface expression of Fn14, CD206, or CD163. In particular, the cells of the invention may be used to treat a fibrotic disease, such as SSc or IPF.

In general, cells that are positive for Fn14, CD206, or CD163 may be identified via known methods, for example, immunofluorescence or flow cytometry using specific antibodies, or alternatively, through CAR cytotoxicity against target cells. Methods of testing a CAR for the ability to recognize target cells and for antigen specificity are known in the art. For instance, Clay et al., *J. Immunol.,* 163: 507-513 (1999), teaches methods of measuring the release of cytokines (e.g., interferon-γ, granulocyte/monocyte colony stimulating factor (GM-CSF), tumor necrosis factor a (TNF-α) or interleukin 2 (IL-2)). In addition, CAR function can be evaluated by measurement of cellular cytotoxicity, as described in Zhao et al., *J. Immunol.,* 174: 4415-4423 (2005).

A biopsy is the removal of tissue and/or cells from an individual. Such removal may be to collect tissue and/or cells from the individual in order to perform experimentation on the removed tissue and/or cells. This experimentation may include experiments to determine if the individual has and/or is suffering from a certain condition or disease-state. The condition or disease may be, e.g., fibrosis. With respect to detecting the presence of cells expressing Fn14, CD206, or CD163 in a host, the sample comprising cells of the host can be a sample comprising whole cells, lysates thereof, or a fraction of the whole cell lysates, e.g., a nuclear or cytoplasmic fraction, a whole protein fraction, or a nucleic acid fraction. If the sample comprises whole cells, the cells can be any cells of the host, e.g., the cells of any organ or tissue, including blood cells or endothelial cells.

Other Targets

The CARs of the present invention, and in particular the CAR-expressing immune cells of the invention, may also be used to treat, prevent, or diagnose any other conditions, disorders, or diseases involving the expression of target molecules described herein (e.g., Fn14, CD206, or CD163). For example, the invention also contemplates a method of treating or preventing diseases associated with fibrosis, inflammation, or DAMs. Such diseases include certain autoimmune diseases, fibrotic diseases, chronic infections, allergies, cancers, metabolic diseases, and cardiovascular diseases. Examples of specific target diseases include, but are not limited to, allergy, asthma, COPD, pulmonary fibrosis, cystic fibrosis, ulcerative colitis, and myelofibrosis, systemic lupus erythematosus (SLE), multiple sclerosis (MS), hepatitis virus infections, various cancers (e.g., brain, breast, esophageal, prostate, gastric, and bladder), obesity, diabetes, and atherosclerosis. The contemplated method comprises administering cells expressing a CAR according to the invention.

Modes of Administration

The compositions of the present invention may be administered in a number of ways depending upon whether local or systemic treatment is desired.

In the case of adoptive cell therapy, methods for administration of cells for adoptive cell therapy are known and may be used in connection with the provided methods and compositions. For example, adoptive T cell therapy methods are described, e.g., in US Patent Application Publication No. 2003/0170238 to Gruenberg et al; U.S. Pat. No. 4,690,915 to Rosenberg; Rosenberg (2011) *Nat Rev Clin Oncol.* 8(10): 577-85). See, e.g., Themeli et al. (2013) *Nat Biotechnol.* 31(10): 928-933; Tsukahara et al. (2013) *Biochem Biophys Res Commun* 438(1): 84-9; Davila et al. (2013) *PLoS ONE* 8(4): e61338.

In general, administration may be topical, parenteral, or enteral.

The compositions of the invention are typically suitable for parenteral administration. As used herein, "parenteral administration" of a pharmaceutical composition includes any route of administration characterized by physical breaching of a tissue of a subject and administration of the pharmaceutical composition through the breach in the tissue, thus generally resulting in the direct administration into the blood stream, into muscle, or into an internal organ. Parenteral administration thus includes, but is not limited to, administration of a pharmaceutical composition by injection of the composition, by application of the composition through a surgical incision, by application of the composition through a tissue-penetrating non-surgical wound, and the like. In particular, parenteral administration is contemplated to include, but is not limited to, subcutaneous, intraperitoneal, intramuscular, intrasternal, intravenous, intraarterial, intrathecal, intraventricular, intraurethral, intracranial, intrasynovial injection or infusions; and kidney dialytic infusion techniques. In a preferred embodiment, parenteral administration of the compositions of the present invention comprises subcutaneous or intraperitoneal administration.

Formulations of a pharmaceutical composition suitable for parenteral administration typically generally comprise the active ingredient combined with a pharmaceutically acceptable carrier, such as sterile water or sterile isotonic saline. Such formulations may be prepared, packaged, or sold in a form suitable for bolus administration or for continuous administration. Injectable formulations may be prepared, packaged, or sold in unit dosage form, such as in ampoules or in multi-dose containers containing a preservative. Formulations for parenteral administration include, but are not limited to, suspensions, solutions, emulsions in oily or aqueous vehicles, pastes, and the like. Such formulations may further comprise one or more additional ingredients including, but not limited to, suspending, stabilizing, or dispersing agents. In one embodiment of a formulation for parenteral administration, the active ingredient is provided in dry (i.e. powder or granular) form for reconstitution with a suitable vehicle (e.g. sterile pyrogen-free water) prior to parenteral administration of the reconstituted composition. Parenteral formulations also include aqueous solutions which may contain excipients such as salts, carbohydrates and buffering agents (preferably to a pH of from 3 to 9), but, for some applications, they may be more suitably formulated as a sterile non-aqueous solution or as a dried form to be used in conjunction with a suitable vehicle such as sterile, pyrogen-free water. Exemplary parenteral administration forms include solutions or suspensions in sterile aqueous solutions, for example, aqueous propylene glycol or dextrose solutions. Such dosage forms can be suitably buffered, if desired. Other parentally-administrable formulations which are useful include those which comprise the active ingredient in microcrystalline form, or in a liposomal preparation. Formulations for parenteral administration may be formulated to be immediate and/or modified release. Modified release formulations include delayed-, sustained-, pulsed-, controlled-, targeted and programmed release.

The terms “oral”, “enteral”, “enterally”, “orally”, “non-parenteral”, “non-parenterally”, and the like, refer to administration of a compound or composition to an individual by a route or mode along the alimentary canal. Examples of “oral” routes of administration of a composition include, without limitation, swallowing liquid or solid forms of a composition from the mouth, administration of a composition through a nasojejunal or gastrostomy tube, intraduodenal administration of a composition, and rectal administration, e.g., using suppositories for the lower intestinal tract of the alimentary canal.

Preferably, the formulated composition comprising isolated CAR-expressing cells is suitable for administration via injection.

Pharmaceutical compositions and formulations for topical administration may include transdermal patches, ointments, lotions, creams, gels, drops, suppositories, sprays, liquids, semi-solids, monophasic compositions, multiphasic compositions (e.g., oil-in-water, water-in-oil), foams, microsponges, liposomes, nanoemulsions, aerosol foams, polymers, fullerenes, and powders. Conventional pharmaceutical carriers, aqueous, powder or oily buses, thickeners and the like may be necessary or desirable.

Compositions and formulations for oral administration include powders or granules, suspensions or solutions in water or non-aqueous media, capsules, sachets or tablets. Thickeners, flavoring agents, diluents, emulsifiers, dispersing aids or binders may be desirable.

Compositions and formulations for parenteral, intrathecal, or intraventricular administration may include sterile aqueous solutions that may also contain buffers, diluents and other suitable additives such as, but not limited to, penetration enhancers, carder compounds and other pharmaceutically acceptable carriers or excipients.

Pharmaceutical compositions of the present invention include, but are not limited to, solutions, emulsions, and liposome-containing formulations. These compositions may be generated from a variety of components that include, but are not limited to, preformed liquids, self-emulsifying solids and self-emulsifying semisolids.

The pharmaceutical compositions of the present invention, which may conveniently be presented in unit dosage form, may be prepared according to conventional techniques well known in the pharmaceutical industry. Such techniques include the step of bringing into association the active ingredients with the pharmaceutical carrier(s) or excipient(s). In general the formulations are prepared by uniformly and intimately bringing into association the active ingredients with liquid carriers or finely divided solid carriers or both, and then, if necessary, shaping the product.

The compositions of the present invention may be formulated into any of many possible dosage forms such as, but not limited to, tablets, capsules, liquid syrups, soft gels, suppositories, aerosols, and enemas. The compositions of the present invention may also be formulated as suspensions in aqueous, non-aqueous or mixed media. Aqueous suspensions may further contain substances that increase the viscosity of the suspension including, for example, sodium carboxymethylcellulose, sorbitol and/or dextran. The suspension may also contain stabilizers.

In one embodiment of the present invention the pharmaceutical compositions may be formulated and used as foams. Pharmaceutical foams include formulations such as, but not limited to, emulsions, microemulsions, creams, jellies and liposomes. While basically similar in nature these formulations vary in the components and the consistency of the final product. Agents that enhance uptake of oligonucleotides at the cellular level may also be added to the pharmaceutical and other compositions of the present invention. For example, cationic lipids, such as lipofectin (U.S. Pat. No. 5,705,188), cationic glycerol derivatives, and polycationic molecules, such as polylysine (WO 97/30731), also enhance the cellular uptake of oligonucleotides.

The compositions of the present invention may additionally contain other adjunct components conventionally found in pharmaceutical compositions. Thus, for example, the compositions may contain additional, compatible, pharmaceutically-active materials such as, for example, antipruritics, astringents, local anesthetics or anti-inflammatory agents, or may contain additional materials useful in physically formulating various dosage forms of the compositions of the present invention, such as dyes, flavoring agents, preservatives, antioxidants, opacifiers, thickening agents and stabilizers. However, such materials, when added, should not unduly interfere with the biological activities of the components of the compositions of the present invention. The formulations can be sterilized and, if desired, mixed with auxiliary agents, e.g., lubricants, preservatives, stabilizers, wetting agents, emulsifiers, salts for influencing osmotic pressure, buffers, colorings, flavorings and/or aromatic substances and the like which do not deleteriously interact with the nucleic acid(s) of the formulation.

Formulations comprising populations of the CAR-expressing cells of the present invention may include pharmaceutically acceptable excipient(s). Excipients included in the formulations will have different purposes depending, for example, on the CAR construct, the subpopulation of cells used, and the mode of administration. Examples of generally used excipients include, without limitation: saline, buffered saline, dextrose, water-for-infection, glycerol, ethanol, and combinations thereof, stabilizing agents, solubilizing agents and surfactants, buffers and preservatives, tonicity agents, bulking agents, and lubricating agents. The formulations comprising populations of the CAR-expressing cells of the present invention will typically have been prepared and cultured in the absence of any non-human components, such as animal serum (e.g., bovine serum albumin).

The formulation or composition may also contain more than one active ingredient useful for the particular indication, disease, or condition being treated with the binding molecules or cells, preferably those with activities complementary to the binding molecule or cell, where the respective activities do not adversely affect one another. Such active ingredients are suitably present in combination in amounts that are effective for the purpose intended. Thus, in some embodiments, the pharmaceutical composition further includes other pharmaceutically active agents or drugs, such as chemotherapeutic agents, e.g., asparaginase, busulfan, carboplatin, cisplatin, daunorubicin, doxorubicin, fluorouracil, gemcitabine, hydroxyurea, methotrexate, paclitaxel, rituximab, vinblastine, vincristine, etc.

The pharmaceutical composition in some aspects can employ time-released, delayed release, and sustained release delivery systems such that the delivery of the composition occurs prior to, and with sufficient time to cause, sensitization of the site to be treated. Many types of release delivery systems are available and known. Such systems can avoid repeated administrations of the composition, thereby increasing convenience to the subject and the physician.

Dosing

The pharmaceutical composition in some embodiments contains cells expressing the CAR of the present invention in amounts effective to treat or prevent the disease or condition, such as a therapeutically effective or prophylactically effective amount. Therapeutic or prophylactic efficacy in some embodiments is monitored by periodic assessment of treated subjects. For repeated administrations over several days or longer, depending on the condition, the treatment is repeated until a desired suppression of disease symptoms occurs. However, other dosage regimens may be useful and can be determined. The desired dosage can be delivered by a single bolus administration of the composition, by multiple bolus administrations of the composition, or by continuous infusion administration of the composition.

In certain embodiments, in the context of genetically engineered cells expressing the CARs, a subject is administered the range of about one million to about 100 billion cells, such as, e.g., 1 million to about 50 billion cells (e.g., about 5 million cells, about 25 million cells, about 500 million cells, about 1 billion cells, about 5 billion cells, about 20 billion cells, about 30 billion cells, about 40 billion cells, or a range defined by any two of the foregoing values), such as about 10 million to about 100 billion cells (e.g., about 20 million cells, about 30 million cells, about 40 million cells, about 60 million cells, about 70 million cells, about 80 million cells, about 90 million cells, about 10 billion cells, about 25 billion cells, about 50 billion cells, about 75 billion cells, about 90 billion cells, or a range defined by any two of the foregoing values), and in some cases about 100 million cells to about 50 billion cells (e.g., about 120 million cells, about 250 million cells, about 350 million cells, about 450 million cells, about 650 million cells, about 800 million cells, about 900 million cells, about 3 billion cells, about 30 billion cells, about 45 billion cells) or any value in between these ranges, and/or such a number of cells per kilogram of body weight of the subject. For example, in some embodiments the administration of the cells or population of cells can comprise administration of about $10^3$ to about $10^9$ cells per kg body weight including all integer values of cell numbers within those ranges.

The cells or population of cells can be administrated in one or more doses. In some embodiments, said effective amount of cells can be administrated as a single dose. In some embodiments, said effective amount of cells can be administrated as more than one dose over a period time. Timing of administration is within the judgment of managing physician and depends on the clinical condition of the patient. The cells or population of cells may be obtained from any source, such as a blood bank or a donor. While individual needs vary, determination of optimal ranges of effective amounts of a given cell type for a particular disease or conditions within the skill of the art. An effective amount means an amount which provides a therapeutic or prophylactic benefit. The dosage administrated will be dependent upon the age, health and weight of the recipient, kind of concurrent treatment, if any, frequency of treatment and the nature of the effect desired. In some embodiments, an effective amount of cells or composition comprising those cells are administrated parenterally. In some embodiments, administration can be an intravenous administration. In some embodiments, administration can be directly done by injection into the disease site.

For purposes of the invention, the amount or dose of the inventive CAR material administered should be sufficient to effect a therapeutic or prophylactic response in the subject or animal over a reasonable time frame. For example, the dose of the inventive CAR material should be sufficient to bind to antigen, or detect, treat or prevent disease in a period of from about 2 hours or longer, e.g., about 12 to about 24 or more hours, from the time of administration. In certain embodiments, the time period could be even longer. The dose will be determined by the efficacy of the particular inventive CAR material and the condition of the animal (e.g., human), as well as the body weight of the animal (e.g., human) to be treated.

For purposes of the invention, an assay, which comprises, for example, comparing the extent to which target cells are lysed or IFN-γ is secreted by T cells expressing the inventive CAR, polypeptide, or protein upon administration of a given dose of such T cells to a mammal, among a set of mammals of which is each given a different dose of the T cells, could be used to determine a starting dose to be administered to a mammal. The extent to which target cells are lysed or IFN-γ is secreted upon administration of a certain dose can be assayed by methods known in the art.

In some embodiments, the cells are administered as part of a combination treatment, such as simultaneously with or sequentially with, in any order, another therapeutic intervention, such as an antibody or engineered cell or receptor or agent, such as a cytotoxic or therapeutic agent. The cells or antibodies in some embodiments are co-administered with one or more additional therapeutic agents or in connection with another therapeutic intervention, either simultaneously or sequentially in any order. In some contexts, the cells are co-administered with another therapy sufficiently close in time such that the cell populations enhance the effect of one or more additional therapeutic agents, or vice versa. In some embodiments, the cells or antibodies are administered prior to the one or more additional therapeutic agents. In some embodiments, the cells or antibodies are administered after to the one or more additional therapeutic agents.

In some embodiments, a lymphodepleting chemotherapy is administered to the subject prior to, concurrently with, or after administration (e.g., infusion) of CAR cells. In an example, the lymphodepleting chemotherapy is administered to the subject prior to administration of the cells. For example, the lymphodepleting chemotherapy ends 1-4 days (e.g., 1, 2, 3, or 4 days) prior to CAR cell infusion. In embodiments, multiple doses of CAR cells are administered, e.g., as described herein. In embodiments, a lymphodepleting chemotherapy is administered to the subject prior to, concurrently with, or after administration (e.g., infusion) of a CAR-expressing cell described herein. Examples of lymphodepletion include, but may not be limited to, nonmyeloablative lymphodepleting chemotherapy, myeloablative lymphodepleting chemotherapy, total body irradiation, etc. Examples of lymphodepleting agents include, but are not limited to, antithymocyte globulin, anti-CD3 antibodies, anti-CD4 antibodies, anti-CD8 antibodies, anti-CD52 antibodies, anti-CD2 antibodies, TCRαβ blockers, anti-CD20 antibodies, anti-CD19 antibodies, Bortezomib, rituximab, anti-CD154 antibodies, rapamycin, CD3 immunotoxin, fludarabine, cyclophosphanide, busulfan, melphalan, Mabthera, Tacrolimus, alefacept, alemtuzumab, OKT3, OKT4, OKT8, OKT1, fingolimod, anti-CD40 antibodies, anti-BR3 antibodies, Campath-1H, anti-CD25 antibodies, calcineurin inhibitors, mycophenolate, and steroids, which may be used alone or in combination.

Variations included in the scope of the invention are functional portions of the inventive CARs described herein. The term "functional portion" when used in reference to a CAR refers to any part or fragment of the CAR of the invention, which part or fragment retains the biological activity of the CAR of which it is a part (the parent CAR). Functional portions encompass, for example, those parts of a CAR that retain the ability to recognize target cells, or detect, treat, or prevent a disease, to a similar extent, the same extent, or to a higher extent, as the parent CAR. In reference to the parent CAR, the functional portion can comprise, for instance, about 10%, 25%, 30%, 50%, 68%, 80%, 90%, 95%, or more, of the parent CAR.

The functional portion can comprise additional amino acids at the amino or carboxy terminus of the portion, or at both termini, which additional amino acids are not found in the amino acid sequence of the parent CAR. Desirably, the additional amino acids do not interfere with the biological function of the functional portion, e.g., recognize target cells, detect, treat, or prevent fibrosis and/or inflammation, etc. More desirably, the additional amino acids enhance the biological activity, as compared to the biological activity of the parent CAR.

Included in the scope of the invention are functional variants of the inventive CARs described herein. The term "functional variant" as used herein refers to a CAR, polypeptide, or protein having substantial or significant sequence identity or similarity to a parent CAR, which functional variant retains the biological activity of the CAR of which it is a variant. Functional variants encompass, for example, those variants of the CAR described herein (the parent CAR) that retain the ability to recognize target cells to a similar extent, the same extent, or to a higher extent, as the parent CAR. In reference to the parent CAR, the functional variant can, for instance; be at least about 30%, 50%, 75%, 80%, 90%, 98% or more identical in amino acid sequence to the parent CAR.

A functional variant can, for example, comprise the amino acid sequence of the parent CAR with at least one conservative amino acid substitution. Alternatively or additionally, the functional variants can comprise the amino acid sequence of the parent CAR with at least one non-conservative amino acid substitution. In this case, it is preferable for the non-conservative amino acid substitution to not interfere with or inhibit the biological activity of the functional variant. The non-conservative amino acid substitution may enhance the biological activity of the functional variant, such that the biological activity of the functional variant is increased as compared to the parent CAR.

Amino acid substitutions of the inventive CARs are preferably conservative amino acid substitutions. Conservative amino acid substitutions are known in the art, and include amino acid substitutions in which one amino acid having certain physical and/or chemical properties is exchanged for another amino acid that has the same or similar chemical or physical properties. For instance, the conservative amino acid substitution can be an acidic/negatively charged polar amino acid substituted for another acidic/negatively charged polar amino acid (e.g., Asp or Glu), an amino acid with a nonpolar side chain substituted for another amino acid with a nonpolar side chain (e.g., Ala, Gly, Val, Ile, Leu, Met, Phe, Pro, Trp, Cys, Val, etc.), a basic/positively charged polar amino acid substituted for another basic/positively charged polar amino acid (e.g. Lys, His, Arg, etc.), an uncharged amino acid with a polar side chain substituted for another uncharged amino acid with a polar side chain (e.g., Asn, Gln, Ser, Thr, Tyr, etc.), an amino acid with a β-branched side-chain substituted for another amino acid with a β-branched side-chain (e.g., Ile, Thr, and Val), an amino acid with an aromatic side-chain substituted for another amino acid with an aromatic side chain (e.g., His, Phe, Trp, and Tyr), etc.

Also, amino acids may be added or removed from the sequence based on vector design.

The CAR can consist essentially of the specified amino acid sequence or sequences described herein, such that other components, e.g., other amino acids, do not materially change the biological activity of the functional variant.

The CARs of embodiments of the invention (including functional portions and functional variants) can be of any length, i.e., can comprise any number of amino acids, provided that the CARs (or functional portions or functional variants thereof) retain their biological activity, e.g., the ability to specifically bind to antigen, detect diseased cells in a mammal, or treat or prevent disease in a mammal, etc. For example, the CAR can be about 50 to about 5000 amino acids long, such as 50, 70, 75, 100, 125, 150, 175, 200, 300, 400, 500, 600, 700, 800, 900, 1000 or more amino acids in length.

The CARs of embodiments of the invention (including functional portions and functional variants of the invention) can comprise synthetic amino acids in place of one or more naturally-occurring amino acids. Such synthetic amino acids are known in the art, and include, for example, aminocyclohexane carboxylic acid, norleucine, α-amino n-decanoic acid, homoserine, S-acetylaminomethyl-cysteine, trans-3- and trans-4-hydroxyproline, 4-aminophenylalanine, 4-nitrophenylalanine, 4-chlorophenylalanine, 4-carboxyphenylalanine, β-phenylserine β-hydroxyphenylalanine, phenylglycine, α-naphthylalanine, cyclohexylalanine, cyclohexylglycine, indoline-2-carboxylic acid, 1,2,3,4-tetrahydroisoquinoline-3-carboxylic acid, aminomalonic acid, aminomalonic acid monoamide, N-benzyl-N'-methyl-lysine, N',N'-dibenzyl-lysine, 6-hydroxylysine, ornithine, α-aminocyclopentane carboxylic acid, α-aminocyclohexane carboxylic acid, α-aminocycloheptane carboxylic acid, α-(2-amino-2-norbornane)-carboxylic acid, α,γ-diaminobutyric acid, α,β-diaminopropionic acid, homophenylalanine, and α-tert-butylglycine.

The CARs of embodiments of the invention (including functional portions and functional variants) can be glycosylated, amidated, carboxylated, phosphorylated, esterified, N-acylated, cyclized via, e.g., a disulfide bridge, or converted into an acid addition salt and/or optionally dimerized or polymerized, or conjugated.

The CARs of embodiments of the invention (including functional portions and functional variants thereof) can be obtained by methods known in the art. The CARs may be made by any suitable method of making polypeptides or proteins. Suitable methods of de novo synthesizing polypeptides and proteins are described in references, such as Chan et al., "Fmoc Solid Phase Peptide Synthesis", Oxford University Press, Oxford, United Kingdom, 2000; "Peptide and Protein Drug Analysis", ed. Reid, R., Marcel Dekker, Inc., 2000; "Epitope Mapping", ed. Westwood et al., "Oxford University Press, Oxford, United Kingdom, 2001; and U.S. Pat. No. 5,449,752. Also, polypeptides and proteins can be recombinantly produced using the nucleic acids described herein using standard recombinant methods. See, for instance, Sambrook et al., "Molecular Cloning: A Laboratory Manual", 3rd ed., Cold Spring Harbor Press, Cold Spring Harbor, N.Y. 2001; and Ausubel et al., "Current Protocols in Molecular Biology", Greene Publishing Associates and John Wiley & Sons, N Y, 1994. Further, some of the CARs of the invention (including functional portions and functional variants thereof) can be isolated and/or purified from a source, such as a plant, a bacterium, an insect, a mammal, e.g., a rat, a human, etc. Methods of isolation and purification are well-known in the art. Alternatively, the CARs described herein (including functional portions and functional variants thereof) can be commercially synthesized by companies. In this respect, the inventive CARs can be synthetic, recombinant, isolated, and/or purified.

Definitions

The term "4-1BB" or "BB" refers to a member of the TNFR superfamily with an amino acid sequence provided as GenBank Acc. No. AAA53133.1, or the equivalent residues from a non-human species, e.g., mouse, rodent, monkey, ape and the like. In one aspect, the "4-1BB costimulatory domain" is the sequence provided as SEQ ID NO: 216 or the equivalent residues from a non-human species, e.g., mouse, rodent, monkey, ape and the like.

As used herein, a "5' cap" (also termed an RNA cap, an RNA 7-methylguanosine cap or an RNA $m^7G$ cap) is a modified guanine nucleotide that has been added to the "front" or 5' end of a eukaryotic messenger RNA shortly after the start of transcription. The 5' cap consists of a terminal group which is linked to the first transcribed nucleotide. Its presence is critical for recognition by the ribosome and protection from RNases. Cap addition is coupled to transcription, and occurs co-transcriptionally, such that each influences the other. Shortly after the start of transcription, the 5' end of the mRNA being synthesized is bound by a cap-synthesizing complex associated with RNA polymerase. This enzymatic complex catalyzes the chemical reactions that are required for mRNA capping. Synthesis proceeds as a multi-step biochemical reaction. The capping moiety can be modified to modulate functionality of mRNA such as its stability or efficiency of translation.

The term "allogeneic" or "donor-derived" refers to any material derived from a different animal of the same species as the individual to whom the material is introduced. Two or more individuals are said to be allogeneic to one another when the genes at one or more loci are not identical. In some aspects, allogeneic material from individuals of the same species may be sufficiently unlike genetically to interact antigenically.

The term "antibody" or "Ab," as used herein, refers to an immunoglobulin molecule which specifically binds with an antigen. In some embodiments, the antigen is a molecule expressed in a fibrotic or inflammatory condition, or expressed on DAMs. In one aspect, the antigen is CD206. In another aspect, the antigen is CD163. In yet another aspect, the antigen is Fn14. Antibodies can be intact immunoglobulins derived from natural sources or from recombinant sources and can be immunoreactive portions of intact immunoglobulins. The term is used in the broadest sense and includes polyclonal and monoclonal antibodies, including intact antibodies and functional (antigen-binding) antibody fragments, including fragment antigen binding (Fab) fragments, $F(ab')_2$ fragments, Fab' fragments, Fv fragments, recombinant IgG (rIgG) fragments, single chain antibody fragments, including single chain variable fragments (scFv), diabodies, and single domain antibodies (e.g., sdAb, sdFv, nanobody) fragments. The term encompasses genetically engineered and/or otherwise modified forms of immunoglobulins, such as intrabodies, peptibodies, chimeric antibodies, fully human antibodies, humanized antibodies, and heteroconjugate antibodies, multispecific, e.g., bispecific, antibodies, diabodies, triabodies, and tetrabodies, tandem di-scFv, tandem tri-scFv. Unless otherwise stated, the term "antibody" should be understood to encompass functional antibody fragments thereof. The term also encompasses intact or full-length antibodies, including antibodies of any class or sub-class, including IgG and sub-classes thereof, IgM, IgE, IgA, and IgD.

The term "antibody fragment" or "Ab fragment" refers to a portion of an intact antibody and refers to the antigenic determining variable regions of an intact antibody. Examples of antibody fragments include, but are not limited to, fragment antigen binding (Fab) fragments, $F(ab')_2$ fragments, Fab' fragments, Fv fragments, recombinant IgG (rIgG) fragments, single chain antibody fragments, including single chain variable fragments (scFv), single domain antibodies (e.g., sdAb, sdFv, nanobody) fragments, diabodies, and multispecific antibodies formed from antibody fragments. In a specific embodiment, the antibody fragment is an scFv.

An "antibody heavy chain," as used herein, refers to the larger of the two types of polypeptide chains present in all antibody molecules in their naturally occurring conformations.

An "antibody light chain," as used herein, refers to the smaller of the two types of polypeptide chains present in all antibody molecules in their naturally occurring conformations. Kappa and lambda light chains refer to the two major antibody light chain isotypes. By the term "synthetic antibody" as used herein, is meant an antibody which is generated using recombinant DNA technology, such as, for example, an antibody expressed by a bacteriophage as described herein. The term should also be construed to mean an antibody which has been generated by the synthesis of a DNA molecule encoding the antibody and which DNA molecule expresses an antibody protein, or an amino acid sequence specifying the antibody, wherein the DNA or amino acid sequence has been obtained using synthetic DNA or amino acid sequence technology which is available and well known in the art.

The term "antigen" or "Ag" refers to a molecule that provokes an immune response. This immune response may involve either antibody production, or the activation of specific immunologically-competent cells, or both. The skilled artisan will understand that any macromolecule, including virtually all proteins or peptides, can serve as an antigen. Furthermore, antigens can be derived from recombinant or genomic DNA. A skilled artisan will understand that any DNA, which comprises a nucleotide sequence or a partial nucleotide sequence encoding a protein that elicits an immune response therefore encodes an "antigen" as that term is used herein. Furthermore, one skilled in the art will understand that an antigen need not be encoded solely by a full length nucleotide sequence of a gene. It is readily apparent that the present invention includes, but is not limited to, the use of partial nucleotide sequences of more than one gene and that these nucleotide sequences are arranged in various combinations to encode polypeptides that elicit the desired immune response. Moreover, a skilled artisan will understand that an antigen need not be encoded by a "gene" at all. It is readily apparent that an antigen can be generated, synthesized, or can be derived from a biological sample, or might be a macromolecule besides a polypeptide. Such a biological sample can include, but is not limited to a tissue sample, a fibrotic tissue sample, an inflamed tissue sample, a cell, or a fluid with other biological components. In some embodiments, the antigen is a molecule expressed in a fibrotic or inflammatory condition, or expressed on DAMs. In one aspect, the antigen is CD206. In another aspect, the antigen is CD163. In yet another aspect, the antigen is Fn14.

The term "antigen binding domain" or "AB domain" refers to one or more extracellular domains of the chimeric antigen receptor (CAR) which have specificity for a particular antigen.

The term "apheresis" as used herein refers to the art-recognized extracorporeal process by which the blood of a donor or patient is removed from the donor or patient and passed through an apparatus that separates out selected particular constituent(s) and returns the remainder to the circulation of the donor or patient, e.g., by retransfusion. Thus, in the context of "an apheresis sample" refers to a sample obtained using apheresis.

The term "autologous" or refers to any material derived from the same individual to whom it is later to be re-introduced.

The term "bind" refers to an attractive interaction between two molecules that results in a stable association in which the molecules are in close proximity to each other. The result of molecular binding is sometimes the formation of a molecular complex in which the attractive forces holding the components together are generally non-covalent, and thus are normally energetically weaker than covalent bonds.

The term "cancer" refers to a disease characterized by the uncontrolled growth of aberrant cells. Cancer cells can spread locally or through the bloodstream and lymphatic system to other parts of the body. Examples of various cancers are described herein and include, but are not limited to ovarian cancer, renal cancer, lung cancer, breast cancer, prostate cancer, cervical cancer, skin cancer, pancreatic cancer, colorectal cancer, liver cancer, brain cancer, lymphoma, leukemia, and the like.

The term "CD163" as used herein refers to the scavenger receptor cystein-rich type 1 protein M130 and is also called the hemoglobin scavenger receptor. In humans, CD163 is encoded by the CD163 gene on chromosome 12, with gene location 12p13.31 (NCBI). Human CD163 has an amino acid sequence provided as GenBank Acc. No. AAY99762.1, or the equivalent residues from a non-human species, e.g., mouse, rodent, monkey, ape, and the like. Mouse CD163 has an amino acid sequence provided as GenBank Acc. No. AAI44849.1, or the equivalent residues from a non-mouse species, e.g., human, rodent, monkey, ape, and the like. In one aspect, human CD163 has the sequence provided as SEQ ID NO: 102, or the equivalent residues from a non-human species, e.g., mouse, rodent, monkey, ape, and the like. In one aspect, mouse CD163 has the sequence provided as SEQ ID NO: 702, or the equivalent residues from a non-mouse species, e.g., human, rodent, monkey, ape, and the like. CD163 is expressed on alternatively activated, M2, or M2c MPs, and elevated production of CD163 by DAMs is seen in a variety of diseases including SSc (Higashi-Kuwata N., et al., "Alternatively activated macrophages (M2 macrophages) in the skin of patient with localized scleroderma", *Exp Dermatol.* 2009 August; 18(8):727-9.; Higashi-Kuwata N., et al., "Characterization of monocyte/macrophage subsets in the skin and peripheral blood derived from patients with systemic sclerosis", *Arthritis Res Ther.* 2010; 12(4)).

The term "CD206" refers to the protein also known as mannose receptor (MR), macrophage mannose receptor (MMR), macrophage mannose receptor 1 (MMR1), C-type mannose receptor 1 (MRC1), or C-type lectin domain family member D (CLEC13D). In humans, CD206 is encoded by the MRC1 gene on chromosome 10, with gene location 10p12.33 (NCBI). Human CD206 has an amino acid sequence provided as NCBI Reference Sequence: NP_002429.1, or the equivalent residues from a non-human species, e.g., mouse, rodent, monkey, ape, and the like. Mouse CD206 has an amino acid sequence provided as NCBI Reference Sequence: NP_032651.2, or the equivalent residues from a non-mouse species, e.g., human, rodent, monkey, ape, and the like. In one aspect, human CD206 has the sequence provided as SEQ ID NO: 101, or the equivalent residues from a non-human species, e.g., mouse, rodent, monkey, ape, and the like. In one aspect, mouse CD206 has the sequence provided as SEQ ID NO: 701, or the equivalent residues from a non-mouse species, e.g., human, rodent, monkey, ape, and the like. CD206 is a C-type lectin primarily present on MPs, often found on M2, M2a, M2b, or M2c MPs, and overexpression of CD206 on DAMs is confirmed in many diseases including cancers (Luo, Y., et al., "Targeting tumor-associated macrophages as a novel strategy against beast cancer", *J Clin Invest.* 2006 August; 116(8): p. 2132-2141). In, SSc CD206 expression is directly correlated with disease severity and mortality (Christmann, R. B., et al., "Interferon and alternative activation of monocyte/macrophages in systemic sclerosis-associated pulmonary arterial hypertension", *Arthritis Rheum,* 2011. 63(6): p. 1718-28).

The term "CD28" refers to the protein Cluster of Differentiation 28, one of the proteins expressed on T cells that provide co-stimulatory signals required for T cell activation and survival. Mouse CD28 protein may have at least 85, 90, 95, 96, 97, 98, 99 or 100% identity to NCBI Reference No: NP_031668.3 or a fragment thereof that has stimulatory activity. Human CD28 protein may have at least 85, 90, 95, 96, 97, 98, 99 or 100% identity to NCBI Reference No: NP_006130 or a fragment thereof that has stimulatory activity.

The term "CD3 zeta," or alternatively, "zeta," "%," "zeta chain," "CD3-zeta," "CD3z," "TCR-zeta," "CD247," or "CD3ζ" is a protein encoded by the CD247 gene on chromosome 1, with gene location 1 H2.3; 173.14 cM, in mice, and by the CD247 gene on chromosome 1, with gene location 1q24.2, in humans. CD3 ζ, together with T cell receptor (TCR) and CD3 (a protein complex composed of a CD3 ζ, a CD3 δ and two CD3 ε, forms the TCR complex. Mouse CD3 ζ may have an amino acid sequence provided as NP_001106864.1, NP_001106863.1, NP_001106862.1, or NP_112439.1, or the equivalent residues from a non-mouse species, e.g., human, rodent, monkey, ape and the like. Human CD3ζ may have an amino acid sequence provided as NP_000725 or NP_932170, or the equivalent residues from a non-human species, e.g., mouse, rodent, monkey, ape and the like.

The term "CD3 zeta intracellular signaling domain," or alternatively "CD3 zeta ICS domain" or a "CD3zICS," is defined as the amino acid residues from the cytoplasmic domain of the CD3 zeta chain, or functional derivatives thereof, that are sufficient to functionally transmit an initial signal necessary for T cell activation. In one aspect, "CD3 zeta ICS domain" is the sequence provided as SEQ ID NO: 147. In one aspect, "CD3 zeta ICS domain" is encoded by the nucleic acid sequence provided as SEQ ID NO: 247.

The term "Chimeric Antigen Receptor" or alternatively a "CAR" refers to a set of polypeptides, typically two in the simplest embodiments, which when in an immune effector cell, provides the cell with specificity for a target cell, and with intracellular signal generation. In some embodiments, a CAR comprises at least an extracellular antigen binding domain (AB domain), a transmembrane domain (TM domain) and a cytoplasmic signaling domain (also referred to herein as "an intracellular signaling domain (ICS domain)") comprising a functional signaling domain derived from a stimulatory molecule and/or costimulatory molecule as defined below. In some aspects, the set of polypeptides are contiguous with each other. In some embodiments, the set of polypeptides include a dimerization switch that, upon the presence of a dimerization molecule, can couple the polypeptides to one another, e.g., can couple an AB domain to an ICS domain. In one aspect, the stimulatory molecule is the zeta chain associated with the T cell receptor complex. In one aspect, the cytoplasmic portion of a CAR further comprises a costimulatory domain (CS domain) comprising one or more functional signaling domains derived from at least one costimulatory molecule as defined below. In one aspect, the costimulatory molecule is chosen from the costimulatory molecules described herein, e.g., 4-1BB (i.e., CD137), DAP10 and/or CD28. In one aspect, the CAR comprises a chimeric fusion protein comprising an extracellular AB domain, a TM domain and an ICS domain comprising a functional signaling domain derived from a stimulatory molecule. In one aspect, the CAR comprises a chimeric fusion protein comprising an extracellular AB domain, a TM domain, an ICS domain comprising a functional signaling domain derived from a stimulatory molecule, and a CS domain comprising a functional signaling domain derived from a costimulatory molecule. In one aspect, the CAR comprises a chimeric fusion protein comprising an extracellular AB domain, a TM domain, an ICS domain comprising a functional signaling domain derived from a stimulatory molecule, and two CS domains each of the two comprising a functional signaling domain derived from a costimulatory molecule(s) that is/are same with or different from each other. In one aspect, the CAR comprises a chimeric fusion protein comprising an extracellular AB domain, a TM domain, an ICS domain comprising a functional signaling domain derived from a stimulatory molecule, and at least two CS domains each comprising a functional signaling domain derived from a costimulatory molecule(s) that is/are same with or different from each other. In one aspect the CAR comprises an optional leader sequence at the amino-terminus (N-ter) of the CAR fusion protein. In one aspect, the CAR further comprises a leader sequence at the N-terminus of the extracellular antigen binding domain, wherein the leader sequence is optionally cleaved from the antigen binding domain (e.g., an scFv) during cellular processing and localization of the CAR to the cellular membrane.

The term "compete", as used herein with regard to an antibody, means that a first antibody, or an antigen binding fragment (or portion) thereof, binds to an epitope in a manner sufficiently similar to the binding of a second antibody, or an antigen binding portion thereof, such that the result of binding of the first antibody with its cognate epitope is detectably decreased in the presence of the second antibody compared to the binding of the first antibody in the absence of the second antibody. The alternative, where the binding of the second antibody to its epitope is also detectably decreased in the presence of the first antibody, can, but need not be the case. That is, a first antibody can inhibit the binding of a second antibody to its epitope without that second antibody inhibiting the binding of the first antibody to its respective epitope. However, where each antibody detectably inhibits the binding of the other antibody with its cognate epitope or ligand, whether to the same, greater, or lesser extent, the antibodies are said to "cross-compete" with each other for binding of their respective epitope(s). Both competing and cross-competing antibodies are encompassed by the invention. Regardless of the mechanism by which such competition or cross-competition occurs (e.g., steric hindrance, conformational change, or binding to a common epitope, or portion thereof), the skilled artisan would appreciate, based upon the teachings provided herein, that such competing and/or cross-competing antibodies are encompassed and can be useful for the methods disclosed herein.

The terms "complementarity determining region," and "CDR," synonymous with "hypervariable region" or "HVR," are known in the art to refer to non-contiguous sequences of amino acids within antibody variable regions, which confer antigen specificity and/or binding affinity. In general, there are three CDRs in each heavy chain variable region (CDR-H1, CDR-H2, CDR-13) and three CDRs in each light chain variable region (CDR-L1, CDR-L2, CDR-L3). "Framework regions" and "FR" are known in the art to refer to the non-CDR portions of the variable regions of the heavy and light chains. In general, there are four FRs in each full-length heavy chain variable region (FR-H1, FR-H2, FR-H3, and FR-H4), and four FRs in each full-length light chain variable region (FR-L1, FR-L2, FR-L3, and FR-L4).

The term "costimulatory molecule" refers to a cognate binding partner on a T cell that specifically binds with a costimulatory ligand, thereby mediating a costimulatory response by the T cell, such as, but not limited to, proliferation. Costimulatory molecules are cell surface molecules other than antigen receptors or their ligands that contribute to an efficient immune response. Costimulatory molecules include, but are not limited to a protein selected from the group consisting of an MHC class I molecule, TNF receptor proteins, Immunoglobulin-like proteins, cytokine receptors, integrins, signaling lymphocytic activation molecules (SLAM proteins), activating NK cell receptors, a Toll ligand receptor, B7-H3, BAFFR, BTLA, BLAME (SLAMF8), CD2, CD4, CD5, CD7, CD8a, CD8, CD11a, LFA-1 (CD11a/CD18), CD1b, CD11c, CD11d, CD18, CD19, CD19a, CD27, CD28, CD29, CD30, CD40, CD49a, CD49D, CD49f, CD69, CD84, CD96 (Tactile), CD100 (SEMA4D), CD103, OX40 (CD134), 4-1BB (CD137), SLAM (SLAMF1, CD150, IPO-3), CD160 (BY55), SELPLG (CD162), DNAM1 (CD226), Ly9 (CD229), SLAMF4 (CD244, 2B4), ICOS (CD278), CEACAM1, CDS, CRTAM, DAP10, GADS, GITR, HVEM (LIGHTR), IA4, ICAM-1, IL2R β, IL2R γ, IL7R α, ITGA4, ITGA6, ITGAD, ITGAE, ITGAL, ITGAM, ITGAX, ITGB1, ITGB2, ITGB7, KIRDS2, LAT, LFA-1, LIGHT, LTBR, NKG2C, NKG2D, NKp30, NKp44, NKp46, NKp80 (KLRF1), PAG/Cbp, PD-1, PSGL1, SLAMF6 (NTB-A, Ly108), SLAMF7, SLP-76, TNFR2, TRANCE/RANKL, VLA1, VLA-6, and a ligand that specifically binds with CD83. In embodiments wherein a CAR comprises one or more CS domain, each CS domain comprises a functional signaling domain derived from a costimulatory molecule. In some embodiments, the encoded CS domain comprises 4-1BB, CD28, or DAP10. In one embodiment, the CS domain comprises the amino acid sequence of CD28CS, 41BBCS, or DAP10CS (SEQ ID NO: 156, 157, or 158), or nucleotide sequence encoding such (SEQ ID NO: 256, 257, or 258).

The term "cytokines" refers to a broad category of small proteins that are involved in cell signaling. Generally, their release has some effect on the behavior of cells around them. Cytokines may be involved in autocrine signaling, paracrine signaling and/or endocrine signaling as immunomodulating agents. Cytokines include chemokines, interferons, interleukins, lymphokines, and tumor necrosis factors. Cytokines are produced by a broad range of cells, including immune cells like macrophages, B lymphocytes, T lymphocytes and mast cells, as well as endothelial cells, fibroblasts, epithelial cells, and various stromal cells. "Chemokines" are a family of cytokines generally involved in mediating chemotaxis.

The term "cytotoxicity" generally refers to any cytocidal activity resulting from the exposure of the CARs of the invention or cells comprising the same to cells expressing the target molecule of the CAR. This activity may be measured by known cytotoxicity assays, including IFN-γ production assays.

The term "DAP10" refers to a protein, which in humans is encoded by the HSCT gene. It may also be referred to as HCST, KAP10, PIK3AP, or hematopoietic cell signal transducer. In some embodiments, DAP10 may have the sequence provided in Genbank Accession No.: Q9UBK5.1.

The term "Disease-associated macrophages" or "DAMs," as used herein, collectively refers to types of macrophages (MPs) that are at least partially responsible in the pathology or pathogenesis or in exacerbation of symptoms of a disease or medical condition that involves fibrosis, inflammation, and certain kinds of autoimmunity. Examples of such diseases and conditions include, but are not limited to, fibrotic diseases such as systemic sclerosis (SSc), idiopathic pulmonary fibrosis (IPF), cystic fibrosis, ulcerative colitis, and myofibrosis, autoimmune diseases such as systemic lupus erythematosus (SLE) and SSc, allergies such as asthma, cardiovascular diseases such as atherosclerosis, other chronic diseases such as chronic obstructive pulmonary disease (COPD), obesity, and metabolic syndromes, and various types of cancer. DAMs are typically referred to as, for example, alternatively activated MPs, M2 Ms, M2-like MPs, M2a MPs, M2b MPs, M2c MPs, M4 MPs, fibrotic MPs, pro-fibrotic MPs, or tumor-associated MPs (TAMs), depending on the context, function, and phenotype in the art (Murray, P., and Wynn, T. A., "Protective and pathogenic functions of macrophage subsets", *Nat Rev Immunol.* 2011 Oct. 14; 11(11): p. 723-37; Chinetti-Gbaguidi, G., Colin, S., and Staels, B., "Macrophage subsets in atherosclerosis", *Nat Rev Cardiol.* 2015 January; 12(1): p. 10-7). In contrast to types of MPs typically called conventionally-activated MPs or M1 MPs that produce TNF-α, IL-12, or nitric oxide, DAMs as defined herein generally produce cytokines such as, but not limited to, IL-4, IL-10, IL-13, or TGF-β upon activation (Classen, A., Lloberas, J., and Celada, A., "Macrophage activation: classical versus alternative", *Methods Mol Biol.* 2009; 531: p. 29-43).

An "effective amount" or "an amount effective to treat" refers to a dose that is adequate to prevent or treat a disease, condition, or disorder in an individual. Amounts effective for a therapeutic or prophylactic use will depend on, for example, the stage and severity of the disease or disorder being treated, the age, weight, and general state of health of the patient, and the judgment of the prescribing physician. The size of the dose will also be determined by the active selected, method of administration, timing and frequency of administration, the existence, nature, and extent of any adverse side effects that might accompany the administration of a particular active, and the desired physiological effect. It will be appreciated by one of skill in the art that various diseases or disorders could require prolonged treatment involving multiple administrations, perhaps using the inventive CAR materials in each or various rounds of administration.

The term "fibrogenesis" or "fibrogenic" refers to the mechanism and/or process of fibrosis formation.

The term "fibrosis" or "fibrotic" refers to the condition describing formation or deposition of fibrous connective tissue, characterized by excess accumulation of extracellular matrix (ECM) such as collagen, in an organ or tissue. Fibrosis can severely disturb the function of such an organ or tissue. Fibrotic condition is the major pathological feature of many chronic inflammatory diseases such as, but not limited to, systemic sclerosis (SSc), idiopathic pulmonary fibrosis (IPF), cystic fibrosis, ulcerative colitis, and myelofibrosis, asthma, and chronic obstructive pulmonary disease (COPD).

The term "fibrotic disease-modifying molecule" or "FDMM" as used herein refers to a molecule capable of altering a disease condition. Representative disease conditions include an inflammatory condition and a fibrotic condition. Examples of such molecules include IL-37, IL-12, TNF-α, IFN-γ, CCL2, TNFAIP3, and molecules capable of altering the expression level, activation status, or function of a disease-associated protein. When such a disease is SSc, the disease-associated protein is for example TGF-β, TGF-β receptor, IL-6, IL-6 receptor, endothelin receptor type A (EDNRA), endothelin receptor type B (EDNRB), platelet derived growth factor receptor β (PDGFRB), 3-hydroxy-3-methylglutaryl-CoA reductase (HMGCR), phosphodiesterase 5A (PDE5A), signal transducer and activator of transcription 4 (STAT4), platelet derived growth factor receptor α (PDGFRA), kinase insert domain receptor (KDR), fms related tyrosine kinase 1 (FLT1), major histocompatibility complex, class II, DQ β1 (HLA-DQB1), fibroblast growth factor receptor 3 (FGFR3), fibroblast growth factor receptor 1 (FGFR1), fins related tyrosine kinase 4 (FLT4), fibroblast growth factor receptor 2 (FGFR2), fibroblast growth factor receptor 4 (FGFR4), interferon regulatory factor 8 (IRF8), CD247, TNFAIP3 interacting protein 1 (TNIP1), integrin subunit α M (ITGAM), SRY-box 5 (SOX5), zinc finger CCCH-type containing 10 (ZC3H10), TNF α-induced protein 3 (TNFAIP3), BLK proto-oncogene, Src family tyrosine kinase (BLK), ankyrin repeat and sterile a motif domain containing 1A (ANKSA), prostaglandin 12 (prostacyclin) receptor (IP) (PTGIR), KIT proto-oncogene receptor tyrosine kinase (KIT), ABL proto-oncogene 1, non-receptor tyrosine kinase (ABL1), growth factor receptor bound protein 10 (GRB10), chromosome 15 open reading frame 39 (C15orf39), TNF superfamily member 4 (TNFSF4), laminin subunit γ 2 (LAMC2), IKAROS family zinc finger 3 (IKZF3), IL-13, IL-13 receptor, TNF superfamily member 13b (TNFSF13B), membrane spanning 4-domains A1 (MS4A1), sodium voltage-gated channel α subunit 4 (SCN4A), sodium voltage-gated channel c subunit 2 (SCN2A), sodium voltage-gated channel α subunit 8

(SCN8A), sodium voltage-gated channel α subunit 11 (SCN11A), sodium voltage-gated channel αsubunit 7 (SCN7A), sodium voltage-gated channel α subunit 3 (SCN3A), sodium voltage-gated channel α subunit 10 (SCN10A), sodium voltage-gated channel α subunit 5 (SCN5A), sodium voltage-gated channel αsubunit 9 (SCN9A), sodium voltage-gated channel α subunit 1 (SCN1A), ras homolog family member B (RHOB), FK506 binding protein 1A (FKBP1A), SRC proto-oncogene, non-receptor tyrosine kinase (SRC), CD19, connective tissue growth factor (CTGF), CD109, vitamin D (1,25-dihydroxyvitamin D3) receptor (VDR), dickkopf WNT signaling pathway inhibitor 1 (DKK1), serpin family H member 1 (SERPINH1), nuclear receptor subfamily 3 group C member 1 (NR3C1), transforming growth factor β 1 (TGFB1), EPH receptor A2 (EPHA2), src-related kinase lacking C-terminal regulatory tyrosine and N-terminal myristylation sites (SRMS), dihydrofolate reductase (DHFR), HCK proto-oncogene, Src family tyrosine kinase (HCK), YES proto-oncogene 1, Src family tyrosine kinase (YES1), LYN proto-oncogene, Src family tyrosine kinase (LYN), FYN proto-oncogene, Src family tyrosine kinase (FYN), aldehyde dehydrogenase 5 family member A1 (ALDH5A1), fyn related Src family tyrosine kinase (FRK), LCK proto-oncogene, Src family tyrosine kinase (LCK), FGR proto-oncogene, Src family tyrosine kinase (FGR), IL-10, IL-10 receptor, IL-4, IL-4 receptor, or CCL2.

The term "Fn14" refers to the growth factor-inducible 14 (Fn14, or FGF-inducible 14) protein, and is alternatively called TNF-related weak inducer of apoptosis receptor (TWEAK receptor, TWEAKR or TWEAK-R), TNF receptor family member 12A (TNFRSF12A), or CD266. In humans, Fn14 is encoded by the TNFRSF12A gene on chromosome 16, with gene location 16p13.3 (NCBI). Human Fn14 has an amino acid sequence provided as NCBI Reference Sequence: NP_057723.1, or the equivalent residues from a non-human species, e.g., mouse, rodent, monkey, ape, and the like. Mouse Fn14 has an amino acid sequence provided as GenBank Ace. No. AAH25860.1, or the equivalent residues from a non-mouse species, e.g., human, rodent, monkey, ape, and the like. In one aspect, human Fn14 has the sequence provided as SEQ ID NO: 103, or the equivalent residues from a non-human species, e.g., mouse, rodent, monkey, ape, and the like. In one aspect, mouse Fn14 has the sequence provided as SEQ ID NO: 703, or the equivalent residues from a non-mouse species, e.g., human, rodent, monkey, ape, and the like. Fn14 is the only known signaling receptor for the cytokine TWEAK (TNFSF12), and its expression on DAMs and the pathological role is implicated in various pathological settings such as cardiovascular diseases, autoimmune diseases, inflammation, and metabolic syndromes (Moreno J A, et al., ""HMGB1 expression and secretion are increased via TWEAK-Fn14 interaction in atherosclerotic plaques and cultured monocytes", *Arterioscler Thromb Vasc Biol* 2013; 33:612-620; Schapira K, et al. "Fn14-Fc fusion protein regulates atherosclerosis in ApoE124/124 mice and inhibits macrophage lipid uptake in vitro", *Arterioscler Thromb Vasc Biol*(2009) 29:2021-7; Madrigal-Matute, J., "TWEAK/Fn14 interaction promotes oxidative stress through NADPH oxidase activation in macrophages", *Cardiovasc Res.* 2015 Oct. 1; 108(1): p. 139-47; Serafini, B., "Expression of TWEAK and its receptor Fn14 in the multiple sclerosis brain: implications for inflammatory tissue injury", *J Neuropathol Exp Neurol.* 2008 December; 67(12): p. 1137-48; Van Kuijk, A. W., et al. "TWEAK and its receptor Fn14 in the synovium of patients with rheumatoid arthritis compared to psoriatic arthritis and its response to tumour necrosis factor blockade", *Ann Rheum Dis.* 2010 January; 69(1):301-4; Vendrell, J., and Chacon, M. R., "TWEAK: A new player in obesity and diabetes", *Front Immunol.* 2013 Dee 30; 4:488). Fn14 is also expressed on non-MP cells, such as fibroblasts, epithelial cells, and tumor cells, and its pathological role also shown in many diseases including myofibrosis, asthma, COPD, and cancer (Novoyatieva, T., et al., "Deletion of Fn14 receptor protects from right heart fibrosis and dysfunction", *Basic Res Cardiol.* 2013 March; 108(2): p 325; Itoigawa, Y., et al., "TWEAK enhances TGF-b-induced epithelial-mesenchymal transition in human bronchial epithelial cells", *Respir Res.* 2015 Apr. 8; 16:48; Zhou, H., et al., "The TWEAK receptor Fn14 is a novel therapeutic target in melanoma: Immunotoxins targeting Fn14 receptor for malignant melanoma treatment", *J Invest Dermatol.* 2013 April; 133(4): p. 1052-62; Culp, P. A., et al., "Antibodies to TWEAK receptor inhibit human tumor growth through dual mechanisms", *Clin Cancer Res.* 2010 Jan. 15; 16(2): p. 497-508). The term "functional GRX variant" as used herein refers to a variant derived from a wild type GRX, that still has the enzymatic function of glutaredoxin. Various mutations in GRXs were published in the past, including mutations in the enzyme's active site (REF) or the putative caspase cleavage site (REF) and mutations of cysteines that may help reduce oxidization or intramolecular disulfide bond formation (REF). In some embodiments, a GRX variant that may be utilized as an FDMM in the present invention is the functional human GRX1 variant 2 (hGRX1v2), which has the amino acid sequence as set forth in SEQ ID NO: 322. In some embodiments, hGRX1v2 may be encoded by SEQ ID NO: 422. In some embodiments, a GRX variant that may be utilized as an FDMM is the functional human GRX1 variant 12 (hGRX1v12), which has the amino acid sequence as set forth in SEQ ID NO: 332. In some embodiments, hGRX1v12 may be encoded by SEQ ID NO: 432.

The term "glutaredoxin" or "GRX" as used herein refers to a member of the glutaredoxin family, the family of redox enzymes (glutaredoxins, GRXs) that use glutathione as a cofactor. GRXs are oxidized by substrates and reduced non-enzymatically by glutathione (GSH). Namely, GRXs perform de-glutathionylation. For example, human glutaredoxin1 (hGRX1) is encoded by the GLRX gene on chromosome 5, with gene location 5p15 (NCBI), and is a member of human GRX family. hGRX1 has an amino acid sequence provided as NCBI Reference Sequence: NP_001230588.1, NP_001112362.1, NP_001230587.1, or NP_002055.1, or the equivalent residues from a non-human species, e.g., mouse, rodent, monkey, ape, and the like. In one aspect, hGRX1 has the sequence provided as SEQ ID NO: 301, or the equivalent residues from a non-human species, e.g., mouse, rodent, monkey, ape, and the like. In one aspect, hGRX1 may be encoded by the nucleic acid sequence SEQ ID NO: 401. Human glutaredoxin 2 (hGRX2) is encoded by the GLRX2 gene on chromosome 1, with gene location 1p31.2 (NCBI), and is also a member of human GRX family. hGRX2 has an amino acid sequence provided as NCBI Reference Sequence: NP_001230328.1, NP_001306220.1, or NP_057150.2, or the equivalent residues from a non-human species, e.g., mouse, rodent, monkey, ape, and the like. In one aspect, hGRX2 has the sequence provided as SEQ ID NO: 302, or the equivalent residues from a non-human species, e.g., mouse, rodent, monkey, ape, and the like. In one aspect, hGRX2 may be encoded by the nucleic acid sequence SEQ ID NO: 402. Human glutaredoxin 3 (hGRX3) is encoded by the GLRX3 gene on chromosome 10, with gene location 10q26.3 (NCBI Reference Sequence: NC_000010.11), and is also a member of human GRX family. hGRX3 has an amino acid sequence provided as GenBank Accession Number: AAH05289 or the equivalent residues from a non-human species, e.g., mouse, rodent, monkey, ape, and the like. In one aspect, hGRX3 has the sequence provided as SEQ ID NO: 303, or the equivalent residues from a non-human species, e.g., mouse, rodent, monkey, ape, and the like. In one aspect, hGRX3 may be encoded by the nucleic acid sequence SEQ ID NO: 403. Human glutaredoxin 5 (hGRX5) is encoded by the GLRX5 gene on chromosome 14, with gene location 14932.13 (NCBI Reference Sequence: NC_000014.9), and is also a member of human GRX family. hGRX5 has an amino acid sequence provided as GenBank Accession Number: AAH23528.2 or the equivalent residues from a non-human species, e.g., mouse, rodent, monkey, ape, and the like. In one aspect, hGRX5 has the sequence provided as SEQ ID NO: 305, or the equivalent residues from a non-human species, e.g., mouse, rodent, monkey, ape, and the like. In one aspect, hGRX5 may be encoded by the nucleic acid sequence SEQ ID NO: 405. Mouse glutaredoxin 1 (mGRX1) is encoded by the Glrx gene on chromosome 13, with gene location 13 C1; 13 40.95 cM (NCBI), is a member of mouse GRX family. mGRX1 has an amino acid sequence provided as NCBI Reference Sequence: NP_444338.2, or the equivalent residues from a non-mouse species, e.g., human, rodent, monkey, ape, and the like. In one aspect, mouse GRX1 has the sequence provided as SEQ ID NO: 311, or the equivalent residues from a non-mouse species, e.g., human, rodent, monkey, ape, and the like. In one aspect, mGRX1 may be encoded by the nucleic acid sequence SEQ ID NO: 411. Any other members besides hGRX1, hGRX2, hGRX3, hGRX5, or mGRX1 that belong to the GRX family are also included in what are referred to as glutaredoxins (GRXs) herein.

The term "glutathione S-transferase pi" or "GSTP" as used herein refers to a member of the glutaredoxin family, the family of enzymes that catalyze protein S-glutathionylation, or conjugation of the antioxidant molecule, glutathione to reactive cysteines. In some preferred embodiments, the FDMM is GSTP. GSTP is able to attenuate inflammatory responses. For example in studies using the mouse lung alveolar epithelial cell line C10 exposed to lipopolysaccharide (LPS), both si-RNA mediated knockdown of GSTP and the use of an isotype-selective GSTP inhibitor (TLK117) resulted in enhanced transcriptional activity of the transcription factor NF-kappa B and increased production of pro-inflammatory cytokines (Johnes, J. T., et al., ""Glutathione S-transferase pi modulates NF-κB activation and pro-inflammatory responses in lung epithelial cells", *Redox Biol.* 2016 August; 8:375-82.). In humans, GSTP is encoded by the GSTP1 gene on chromosome 11, with gene location 11q13.2 (NCBI Reference Sequence: NC_000011.10). hGSTP has an amino acid sequence provided as GenBank Accession Number: AAA56823.1, AAP72967.1, AAV38752.1, or GenBank: AAV38753.1, or the equivalent residues from a non-human species, e.g., mouse, rodent, monkey, ape, and the like. In one aspect, hGSTP has the sequence provided as SEQ ID NO: 341, or the equivalent residues from a non-human species, e.g., mouse, rodent, monkey, ape, and the like. In one aspect, hGSTP may be encoded by the nucleic acid sequence SEQ ID NO: 441. In mice, GSTP is encoded by the Gstp1 gene on chromosome 19, with gene location 19 A; 19 3.75 cM (NCBI Reference Sequence: NC_000085.6). mGSTP has an amino acid sequence provided as GenBank Accession Number: GenBank: AAH61109.1, or the equivalent residues from a non-mouse species, e.g., human, rodent, monkey, ape, and the like. In one aspect, mGSTP has the sequence provided as SEQ ID NO: 351, or the equivalent residues from a non-human species, e.g., mouse, rodent, monkey, ape, and the like. In one aspect, mGSTP may be encoded by the nucleic acid sequence SEQ ID NO: 451.

The term "hinge", "spacer", or "linker" refers to an amino acid sequence of variable length typically encoded between two or more domains or portions of a polypeptide construct to confer flexibility, improved spatial organization, proximity, etc.

As used herein, "human antibody" means an antibody having an amino acid sequence corresponding to that of an antibody produced by a human and/or which has been made using any of the techniques for making human antibodies known to those skilled in the art or disclosed herein. This definition of a human antibody includes antibodies comprising at least one human heavy chain polypeptide or at least one human light chain polypeptide. One such example is an antibody comprising murine light chain and human heavy chain polypeptides. Human antibodies can be produced using various techniques known in the art. In one embodiment, the human antibody is selected from a phage library, where that phage library expresses human antibodies (Vaughan et al., *Nature Biotechnology,* 14:309-314, 1996; Sheets et al., *Proc. Natl. Acad. Sci.* (USA) 95:6157-6162, 1998; Hogeboom and Winter, *J. Mol. Biol.,* 227:381, 1991; Marks et al., *J. Mol. Biol.,* 222:581, 1991). Human antibodies can also be made by immunization of animals into which human immunoglobulin loci have been transgenically introduced in place of the endogenous loci, e.g., mice in which the endogenous immunoglobulin genes have been partially or completely inactivated. This approach is described in U.S. Pat. Nos. 5,545,807; 5,545,806; 5,569,825; 5,625,126; 5,633,425; and 5,661,016. Alternatively, the human antibody may be prepared by immortalizing human B lymphocytes that produce an antibody directed against a target antigen (such B lymphocytes may be recovered from an individual or from single cell cloning of the cDNA, or may have been immunized in vitro). See, e.g., Cole et al., "Monoclonal Antibodies and Cancer Therapy", Alan R. Liss, p. 77, 1985; Boerner et al., *J. Immunol.,* 147 (1):86-95, 1991; and U.S. Pat. No. 5,750,373.

An "iCAR" is a chimeric antigen receptor which contains inhibitory receptor signaling domains. These domains may be based, for example, on protectin D1 (PD1) or CTLA-4 (CD152). In some embodiments, the CAR expressing cells of the invention are further transduced to express an iCAR. In one aspect, this iCAR is added to restrict the CAR expressing cell's functional activity to tumor cells.

As used herein, "immune cell" refers to a cell of hematopoietic origin functionally involved in the initiation and/or execution of innate and/or adaptive immune response.

The term "inflammation" refers to abroad physiological response responses mediated by various cell types, proteins, humoral factors, and tissues. While inflammation can send signals to our body to help the immune system eliminate pathogens or undesired conditions, inappropriate levels or altered types of inflammation can cause numerous physiological or immunological problems within the body. Such inflammation can be directly responsible for the pathology of various diseases including autoimmune diseases, fibrotic diseases, chronic infections, and allergies (Laria, A. et al., "The macrophages in rheumatic diseases", *J Inflamm Res.* 2016 Feb. 9; 9: p. 1-11; Wynn, T. A., and Ramalingam, T. R., "Mechanisms of fibrosis: fibrotic translation for fibrotic diseases", *Nat Med,* 2012 Jul. 6; 18(7): p. 1028-40; Yang, Z. P., Kuo, C. C., and Grayston, J. T, "Systemic dissemination of *Chlamidia pneumoniae* following intranasal inoculation in mice", *J Infect Dis.* 1995 March; 171(3): p. 736-8; Jian, Z., and Zhu, L., "Update on the role of alternatively activated macrophages in asthma", *J Asthma Allergy,* 2016 Jun. 3; 9: p. 101-7). Inflammation can also indirectly exacerbate the symptoms of many diseases, or play an assisting role in the pathogenesis, for example in cancers, obesity, metabolic diseases, and cardiovascular diseases such as atherosclerosis (Coussens, L. M., and Werb, Z., "Inflammation and Cancer". *Nature.* 2002 Dec. 19-26; 420(6917): p. 860-7; Monteiro, R., and Azevedo, I., "Chronic inflammation in obesity and the metabolic syndrome", *Mediators Inflamm.* 2010; 2010; Libby, P., "Inflammation and cardiovascular disease mechanisms", *Am J Clin Nutr.* 2006 February; 83(2): p. 456S-460S).

The term "internal ribosome entry site" or "IRES" refers to a cis-acting RNA sequence that mediates internal entry of the 40S ribosomal subunit on some eukaryotic and viral messenger RNAs. IRES allows for translation initiation in a 5' cap independent manner during protein synthesis, thus enabling co-expression of two proteins from a single mRNA. Further details and variations of IRES sequences may be found in Bonnal et al., *Nucleic Acids Res.* 2003 Jan. 1; 31(1): 427-428.

An "intracellular signaling domain" or "ICS domain" as the term is used herein, refers to an intracellular portion of a molecule. The intracellular signaling domain generates a signal that promotes an immune effector function of the cell transduced with a nucleic acid sequence comprising a CAR, e.g., a CAR T cell. Examples of immune effector function, e.g., in a CAR T cell, include cytolytic activity and helper activity, including the secretion of cytokines. ICS domains include an ICS domain of a lymphocyte receptor chain, a TCR/CD3 complex protein, an Fc receptor subunit, an IL-2 receptor subunit, CD3 zeta, FcR γ, FcR β, CD3 γ, CD3 δ, CD3 ε, CD5, CD22, CD79a, CD79b, CD66d, CD278 (ICOS), FcεRI, DAP10, or DAP12.

An "isolated" biological component (such as an isolated chimeric antigen receptor or cell or vector or protein or nucleic acid) refers to a component that has been substantially separated or purified away from its environment or other biological components in the cell of the organism in which the component naturally occurs, for instance, other chromosomal and extra-chromosomal DNA and RNA, proteins, and organelles. Nucleic acids and proteins that have been "isolated" include nucleic acids and proteins purified by standard purification methods. The term also embraces nucleic acids and proteins prepared by recombinant technology as well as chemical synthesis. An isolated nucleic acid or protein can exist in substantially purified form, or can exist in a non-native environment such as, for example, a host cell.

The term "linker" as used in the context of an scFv refers to a peptide linker that consists of amino acids such as glycine and/or serine residues used alone or in combination, to link variable heavy and variable light chain regions together. In one embodiment, the flexible polypeptide linker is a Gly/Ser linker and comprises one or more repeats of the amino acid sequence unit Gly-Gly-Gly-Gly-Ser (SEQ ID NO: 139). In one embodiment, the flexible polypeptide linker includes, but is not limited to, $(Gly_4Ser)_3$, which is also referred to as G4S X3 (SEQ ID NO: 140). Such a linker may be encoded for example, by the nucleic acid sequence (SEQ ID NO: 240).

The term "nucleic acid" and "polynucleotide" refer to RNA or DNA that is linear or branched, single or double stranded, or a hybrid thereof. The term also encompasses RNA/DNA hybrids. The following are non-limiting examples of polynucleotides: a gene or gene fragment, exons, introns, mRNA, tRNA, rRNA, ribozymes, cDNA, recombinant polynucleotides, branched polynucleotides, plasmids, vectors, isolated DNA of any sequence, isolated RNA of any sequence, nucleic acid probes and primers. A polynucleotide may comprise modified nucleotides, such as methylated nucleotides and nucleotide analogs, uracil, other sugars and linking groups such as fluororibose and thiolate, and nucleotide branches. The sequence of nucleotides may be further modified after polymerization, such as by conjugation, with a labeling component. Other types of modifications included in this definition are caps, substitution of one or more of the naturally occurring nucleotides with an analog, and introduction of means for attaching the polynucleotide to proteins, metal ions, labeling components, other polynucleotides or solid support. The polynucleotides can be obtained by chemical synthesis or derived from a microorganism. The term "gene" is used broadly to refer to any segment of polynucleotide associated with a biological function. Thus, genes include introns and exons as in genomic sequence, or just the coding sequences as in cDNAs and/or the regulatory sequences required for their expression. For example, gene also refers to a nucleic acid fragment that expresses mRNA or functional RNA, or encodes a specific protein, and which includes regulatory sequences.

The term "OKT3" or "Muromonab-CD3" or "Orthoclone OKT3" refers to a monoclonal anti-CD3 antibody.

A "pharmaceutically acceptable carrier" or "excipient" refers to compounds or materials conventionally used in immunogenic compositions during formulation and/or to permit storage.

The term "promoter", as used herein, is defined as a DNA sequence recognized by the synthetic machinery of the cell, or introduced synthetic machinery, required to initiate the specific transcription of a polynucleotide sequence.

The term "recombinant" means a polynucleotide with semi-synthetic or synthetic origin which either does not occur in nature or is linked to another polynucleotide in an arrangement not found in nature.

The term "scFv," "single-chain Fv," or "single-chain variable fragment" refers to a fusion protein comprising at least one antibody fragment comprising a variable region of a light chain and at least one antibody fragment comprising a variable region of a heavy chain, wherein the light and heavy chain variable regions are contiguously linked, e.g., via a synthetic linker, e.g., a short flexible polypeptide linker, and capable of being expressed as a single chain polypeptide, and wherein the scFv retains the specificity of the intact antibody from which it is derived. Unless specified, as used herein an scFv may have the $V_L$ and $V_H$ variable regions in either order, e.g., with respect to the N-terminal and C-terminal ends of the polypeptide, the scFv may comprise $V_L$-linker-$V_H$ or may comprise $V_H$-linker-$V_L$. The linker may comprise portions of the framework sequences.

A "leader sequence" as used herein, also referred to as "signal peptide," "signal sequence," "targeting signal," "localization signal," "localization sequence," "transit peptide," or "leader peptide" in the art, is a short peptide present at the N-terminus of the majority of newly synthesized proteins that are destined towards the secretary pathway. The core of the signal peptide may contain a long stretch of hydrophobic amino acids. The signal peptide may or may not be cleaved from the mature polypeptide.

The "ribosome skip sequence" refers to an amino acid sequence that, when translated, causes cleavage of a nascent polyprotein on the ribosome, allowing for co-expression of multiple genes. In one aspect, the ribosome skip sequence may be the T2A sequence and comprises the amino acid sequence of SEQ ID NO: 150 or nucleotide sequence encoding such, such as SEQ ID NO: 250. Alternatively, any other 2A sequences may be used. Examples of other 2A sequences may be found elsewhere in the literature of the relevant art (for example, see Kim, J. H., et al., "High cleavage efficiency of a 2A peptide derived from porcine teschovirus-1 in human cell lines, zebrafish and mice" *PLoS One*. 2011; 6(4)).

The term "signaling domain" refers to the functional portion of a protein which acts by transmitting information within the cell to regulate cellular activity via defined signaling pathways by generating second messengers or functioning as effectors by responding to such messengers.

The term "stimulatory molecule," refers to a molecule expressed by an immune cell (e.g., T cell, NK cell, B cell) that provides the cytoplasmic signaling sequence(s) that regulate activation of the immune cell in a stimulatory way for at least some aspect of the immune cell signaling pathway. In one aspect, the signal is a primary signal that is initiated by, for instance, binding of a TCR/CD3 complex with an MHC molecule loaded with peptide, and which leads to mediation of a T cell response, including, but not limited to, proliferation, activation, differentiation, and the like. A primary cytoplasmic signaling sequence (also referred to as a "primary signaling domain") that acts in a stimulatory manner may contain a signaling motif which is known as an immunoreceptor tyrosine-based activation motif or ITAM. Examples of an ITAM containing cytoplasmic signaling sequence that are of particular use in the invention include, but are not limited to, those derived from CD3 ζ, common FcR γ (FCER1G), Fcγ RIIa, FcR β (Fc ε R1b), CD3 γ, CD3 δ, CD3 ε, CD79a, CD79b, DAP10, and DAP12. In a specific CAR of the invention, the intracellular signaling domain in any one or more CARS of the invention comprises an intracellular signaling sequence, e.g., a primary signaling sequence of CD3 ζ. In a specific CAR of the invention, the primary signaling sequence of human CD3 ζ, referred to as "CD3zICS" herein, is the amino acid sequence provided as SEQ ID NO: 147, and may be encoded by the nucleotide sequence SEQ ID NO: 247. In another specific CAR of the invention, the primary signaling sequence of mouse CD3 ζ, referred to as "mCD3zICS" herein, is the amino acid sequence provided as SEQ ID NO: 747, and may be encoded by the nucleotide sequence SEQ ID NO: 847. Alternatively, equivalent residues from a non-human or mouse species, e.g., rodent, monkey, ape and the like, may be utilized.

The term "subject" is intended to include living organisms in which an immune response can be elicited (e.g., mammals, human). The subject may have a disease or may be healthy. The subject may also be referred to as "patient" in the art.

The term "suicide mechanism" as used herein refers to a mechanism by which CAR-expressing cells of present invention may be eradicated from a subject administered with CAR-expressing cells. The suicide mechanism may be driven by, for example, inducible caspase 9 (Budde et al., *PLoS One* 2013 8(12):82742), codon-optimized CD20 (Marin et al., *Hum. Gene Ther. Meth.* 2012 23(6)376-86), CD34, or polypeptide RQR8 (Philip et al, and WO2013153391A, which is hereby incorporated herein by reference). In some embodiments, the suicide mechanism may be included and utilized in CAR-expressing cells of present invention to optimize the length for the CAR-expressing cells to stay in the system of a subject or the amount of the CAR-expressing cells, to reduce or minimize the toxicity and/or to maximize the benefit of CAR-expressing cells.

The term "target cell" as used herein refers to a cell expressing the target molecule of the CAR of the present invention on the cell surface. In some embodiments, the target cell is a disease-associated macrophage (DAM). In some embodiments, the target cell is a fibroblast. In some embodiments, the target cell is an epithelial cell. In some embodiments, the target cell is a cell type that has a particular role in the pathology of fibrosis or inflammation. In some embodiments, the target cell is a cell type that has a particular role in the pathology of a disease such as but not limited to a fibrotic disease (e.g., SSc and IPF), an inflammatory disease (e.g., certain types of autoimmune diseases), cancer, a cardiovascular disease (e.g., atherosclerosis), a metabolic disease (e.g., obesity), or cancer.

The term "target molecule" as used herein refers to a molecule that is targeted by a CAR of the present invention. The AB domain of a CAR of the present invention has a binding affinity for the target molecule. In some embodiments, the target molecule is CD206. In some embodiments, the target molecule is Fn14. In some embodiments, the target molecule is CD163, In some other embodiments, the target molecule is another molecule particularly expressed in a fibrotic setting or expressed on disease-associated macrophages (DAMs).

The term "trCD19" refers to a truncated version of the CD19 protein, B-lymphocyte antigen CD19, also known as CD19 (Cluster of Differentiation 19), which is a protein that is encoded by the CD19 gene in humans and by the CD19 gene in mice and is found on the surface of B-cells. The trCD19 construct is any truncated version of said protein, such that a nucleic acid sequence encoding this construct may be transduced into a host cell and expressed on the surface of this cell for the purposes of detection, selection, and/or targeting. In one aspect, human trCD19 may comprise the amino acid sequence of SEQ ID NO: 151 or nucleotide sequence encoding, such as SEQ ID NO: 251.

The term "transfected," "transformed," or "transduced" refers to a process by which exogenous nucleic acid is transferred or introduced into the host cell. A "transfected" or "transformed" or "transduced" cell is one which has been transfected, transformed or transduced with exogenous nucleic acid. The cell includes the primary subject cell and its progeny.

By the term "transmembrane domain" or "TM domain", what is implied is any three-dimensional protein structure which is thermodynamically stable in a membrane. This may be a single a helix, a transmembrane β barrel, a β-helix of gramicidin A, or any other structure. Transmembrane helices are usually about 20 amino acids in length. Typically, the transmembrane domain denotes a single transmembrane α helix of a transmembrane protein, also known as an integral protein.

As used herein, the terms "treat," "treatment," or "treating" generally refers to the clinical procedure for reducing or ameliorating the progression, severity, and/or duration of a disease, or for ameliorating one or more symptoms (preferably, one or more discernible symptoms) of a disease. The disease may be, for example, a fibrotic disease, an inflammatory disease, or a DAM-associated disease. In specific embodiments, the effect of the "treatment" may be evaluated by the amelioration of at least one measurable physical parameter of a disease, resulting from the administration of one or more therapies (e.g., one or more therapeutic agents such as a CAR of the invention). The parameter may be, for example, gene expression profiles, the mass of disease-affected tissues, inflammation-associated markers, fibrosis-associated markers, the number or frequency of DAMs or other disease-associated cells, the presence or absence of certain cytokines or chemokines or other disease-associated molecules, and may not necessarily discernible by the patient. When the disease is SSc, the parameter may be, for example, the skin thickness or the level of TGF. In other embodiments "treat", "treatment," or "treating" may result in the inhibition of the progression of a disease, either physically by, e.g., stabilization of a discernible symptom, physiologically by, e.g., stabilization of a physical parameter, or both. In other embodiments the terms "treat", "treatment" and "treating" refer to the reduction or stabilization of inflammatory or fibrotic tissue. Additionally, the terms "treat," and "prevent" as well as words stemming therefrom, as used herein, do not necessarily imply 100% or complete cure or prevention. Rather, there are varying degrees of treatment effects or prevention effects of which one of ordinary skill in the art recognizes as having a potential benefit or therapeutic effect. In this respect, the inventive methods can provide any amount of any level of treatment or prevention effects of a disease in a mammal. Furthermore, the treatment or prevention provided by the inventive method can include treatment or prevention of one or more conditions or symptoms of the disease being treated or prevented. Also, for purposes herein, "prevention" can encompass delaying the onset of the disease, or a symptom or condition thereof. The term "TWEAK" or "TNF-related weak inducer of apoptosis" refers to the type II membrane, TNF superfamily member 12 (TNFSF12), and is also called APO3L, DR3LG, or TNLG4A. In humans, TWEAK is encoded by the TNFSF12A gene on chromosome 17, with gene location 17p13.1 (NCBI). Human TWEAK has an amino acid sequence provided as GenBank Acc. No. AAC51923.1, or the equivalent residues from a non-human species, e.g., mouse, rodent, monkey, ape, and the like. In mice, TWEAK is encoded by the Tnfsf12 gene on chromosome 11, with gene location 11; 11 B3 (NCBI). Mouse TWEAK has an amino acid sequence provided as GenBank Ace. No. AAC53517.2, or the equivalent residues from a non-mouse species, e.g., human, rodent, monkey, ape, and the like. TWEAK's only known signaling receptor is Fn14.

The term "xenogeneic" refers to a graft derived from an animal of a different species.

The experimental details of these experiments are described in the following examples. These examples are offered to illustrate, but not to limit, the claimed invention.

EXAMPLES

Example 1: Design and Synthesis of Anti-Fn4 CAR and Anti-CD206 CAR Constructs and CAR-Expressing Cells 1-1: Design of Anti-Fn14 CAR and Anti-CD206 CAR Constructs To express six exemplary CARs, as illustrated in FIG. 6, pFB retroviral vectors were designed to encode the constructs shown in FIG. 7C. A pFB vector encoding just mouse truncated CD19 (mtrCD19) but no CAR or T2A was also designed for mock transduction (FIG. 7C, right-most).

1-2: Synthesis of Viruses

The day before transfection, GP2-293 cells from Retro-X Universal Packaging System™ Clontech cat #631530 (for retroviral packaging) were plated at 10×10$^6$ cells/T25 flask. Three T25 flasks of GP2-293 cells were typically used per construct. PT67 cell culture (for retroviral transduction) was also started. Both cultures were maintained at 37° C. at 5% $CO_2$.

On the day of transfection, Tube 1 and Tube 2 were set up for transfection reaction for each construct as described below. Constructs used were for anti-CD206 CAR and T2A+mtrCD19 (2284_mt9 or 538 mt19), anti-CDFn14 CAR and T2A+mtrCD19 (4A8H_mt19, 4A8L_mt9, 305H_mt19, 3G5L_mt19), or just mtrCD19 (mt19).

Tube 1 (DNA): Total Volume 220 μL a. Retro vector (1 micro gram/microliter): 5 μL
b. Envelop vector (VSVG)(0.5 micro gram/microliter): 10 μL
c. Xfect™ reaction buffer: 205 μL Tube 2 (Polymer): Total Volume 220 μL d. Xfect™ polymer (100 micro gram/μL): 3 μL
e. Xfect™ reaction buffer: 217 μL Tube 2 contents were added to Tube 1, and vortexed at medium speed for 10 see. The mix was incubated at room temperature for 10 min. 440 μL of incubated mix was added to a GP2-293T cell flask, and cells were incubated at 37° C. for 4 hours. The medium was replaced with new medium after the transfection incubation and cells were incubated with the new medium for 72 hours.

The supernatant for each construct was harvested, pooled, and spun at 500 g for 10 min. Supernatant aliquots were made and frozen at −80° C., or kept at 4° C. for immediate use (within a week).

Larger amounts of viruses were generated by transducing PT67 cells with viruses produced in GP2-293T cells.

The night before transduction, PT67 cells were plated at 2.5×10$^4$ cells/ml in DMEM medium, with 2 ml/well and using 2 wells/construct on 6 well plates. The cells were incubated at 37° C. The DMEM medium used in this experiment was made by combining 500 ml of DMEM, 5.5 ml of FBS, 5.5 ml of NEAA, 5.5 ml of HEPES, 5.5 ml of sodium pyruvate, 5.5 ml of pen-strep, and 3 ml of 2-ME.

On the day of transduction, 8 microgram/ml of polybrene was added to virus supernatant. PT67 cells, removed with media, were added with 2 ml of virus supernatant containing polybrene, spun at 1000 ref for 30 min at 32° C., and let sit in the incubator until the next morning with the virus.

Next morning, the medium was replaced with a new batch of virus supernatant containing polybrene, and the plates were spun at 1000 ref for 30 min at 32° C. and incubated for 24 hours at 37° C. (second transduction). The same procedures were repeated for the third transduction.

Starting the next morning, the cells were expanded until about 70% confluence. Once confluent, cells were transferred to a T75 flask. Small fractions of cell samples were used for flow cytometry for mtrCD19 to assess the transduction efficiency. If the efficiency is low, purification with anti-CD19 magnetic beads may be performed.

Some cells were trypsinized for immediate expansion or for cryopreservation. To expand cells, cells were spun at 500 g for 5 min, added with 8-10 ml DMEM to pellet, and seeded in 75T flasks (1 ml/flask). Once about 70% confluent, one 75T flask was expanded in 4-5 225T flasks (65 ml media per flask). To freeze cells, cells were placed in freezing media (90% FBS/10% DMSO) at 2×10$^6$ cells/cryovial.

For collecting viruses, when cells reached 90% confluence, the medium was replaced with 22 ml (for T75) or 65 ml (for 225T) of fresh medium. 36 hours later, the supernatant was harvested and stored at 4° C. 22 ml (for T75) or 65 ml (for 225T) of fresh medium was carefully added to each flask, and 24 hours later the supernatant was harvested and pooled with the previously collected supernatant. Combined supernatant was spun at 500 g for 10 min, and 5 ml or 10 ml aliquots were froze at −80° C. until use.

1 ml aliquot from each construct were used for titration by RT-qPCR. The viruses' functional activity was also tested using human T cell transduction, IFN γ assay, and receptor expression test by flow cytometry.

The DMEM medium used in this experiment was made by combining 500 ml of DMEM, 5.5 ml of FBS, 5.5 ml of NEAA, 5.5 ml of HEPES, 5.5 ml of sodium pyruvate, 5.5 ml of pen-strep, and 3 ml of 2-ME.

1-3: Titration of Viruses

Briefly, viruses were titrated by extracting viral nucleic acid from supernatants, treating the extracted nucleic acids with DNAse, preparing samples and standard dilutions for qPCR, making and aliquoting PCR master mix, running qPCR, and analyzing data.

Equipment used included a heat block (Labline, model 2050), micro centrifuge (USA Scientific, model IR), mini centrifuge (Eppendorf, Model 5418), centrifuge (Eppendorf, model 5810R), thermocycler (BioRad, model T100 Thermal Cycle), Applied Biosystems Step One Plus qPCR System (Applied Biosystems, model 4376592), and Computer (Dell, model Optiplex XE), each of which was operated according to manufacturer recommendations.

Reagents and consumables used were Retro-X™ qRT-PCR Titration Kit (Macherey-Nagel/Clontech, 631453), Ethanol 200 proof (Sigma-Aldrich, E7023), PCR tubes (strips of 8) (Thermo-Scientific, A13-0266), PCR plates (Applied Biosystems, 4346907), and Optical sealing film (Applied Biosystems, 4311971).

1-4: Stimulation of Mouse T Cells Using Concanavalin a (ConA), Transduction of Mouse T Cells with Virus Using IL-2 and Polybrene, Selection and Expansion, and Viability Assay Methods:

The method is summarized in FIG. 8 and described in detail in the following.

On Day 0, mouse splenocytes were harvested and T cells were expanded. Briefly, spleens were harvested from mice (C57BL16, male, 8-10 week), smashed, and spun at 500 ref for 5 min at 20° C., The obtained cells were subjected to red blood cell (RBC) lysis, filtered through a 70 micrometer filter using phosphate buffered saline (PBS), spun at 500 ref for 5 min at 20° C., washed with PBS, suspended at $2\times10^6$ cells/ml in complete RPMI media containing ConA at 1 microgram/ml in 75 $cm^2$ flasks, and incubated for 18-24 hours at 37° C.

On Day 1, transduction was performed. Briefly, cryopreserved viruses encoding anti-CD206 CAR and T2A+ mtrCD19 (2284_mt19 or 538_mt19), encoding anti-CDFn14 CAR and T2A+mtrCD19 (4A8H_mt19, 4A8L_mt19, 3G5H_mt19, 3G5L_mt19), or encoding just mtrCD19 (mt19) were thawed (the viral solution titer range=5-$10\times10^9$ particles/ml). Cells from Day 0 were harvested, spun at 500 ref for 5 min, and resuspended to $2\times10^6$ cells/ml divide into groups containing the appropriate virus, so that 2 ml virus solution was used per 4 ml cell solution. 8 microgram/ml of polybrene (Sigma) and then 24 IU/ml of IL-2 was added to each tube. Cells were plated on a 12 well plate at $4\times10^6$ cells/2 ml/well. A separate plate was used for each virus type to avoid contamination. Plates were covered, sealed with parafilm, spun at 32° C. for 1 hour at 1500 ref, and then the parafilm was removed in the hood. Plates were incubated for 5-6 hours at 37° C. Cells were harvested and spun at 500 ref for 5 min. Cells of each group were placed in complete media containing IL-2 at 25 IU/mL. The cell concentration was about $1\times10^6$ cells/ml.

On Day 3, G418 selection was performed. Briefly, cells were split to about $0.5\times10^6$ cells/ml, and G418 was added at 0.5 mg/ml to select cells that were successfully transduced. IL-2 was added to the new media at 25 IU/ml.

On Day 4, cells were split at 1:1 ratio. IL-2 was added to all complete media at 25 IU/ml before addition to the cells.

On Day 6, live cells were isolated. First, Histopaque™ was warmed to room temperature in dark. Cells in flasks from Day 4 were harvested, and up to $100\times10^6$ cells were resuspended in 13 ml of media. 13 ml cell suspension was placed under 13m Histopaque™ in a tube and spun at 360 ref for 20 min without brake at room temperature. Cells were harvested from the interface, spun at 500 ref for 5 min, and cultured in 75 $cm^2$ flasks at about $0.5\times10^6$ cells/ml with 25 U/ml of IL-2 at 37° C.

On Day 7, cells were split at 1:1 ratio. IL-2 was added to all complete media at 25 IU/ml before addition to the cells.

On Day 8, cells were used for an in vitro or in vivo assay. For cell viability evaluation, cells were left in culture until the following day (Day 9).

Cell viability was measured on Day 1, 3, 6, 7, 8, and 9 using LIVE/DEAD® staining (Invitrogen) according to the manufactures instruction.

Results:

The representative viability assay results of at least three independent experiments are summarized in FIG. 9.

Example 2: Expression of Anti-Fn14 CARs and Anti-CD206 CARs

A schematic showing various exemplary AB domain constructs of CARs of some embodiments are illustrated in FIG. 5.

2-1: Transduction Efficiency Test Based on mtrCD19 Expression—Flow Cytometry

Reagents:

- FACS buffer (1% FBS in PBS)
- FcR blocker (purchased from Dartmouth IML Core Lab, BXL 2.4G2 Lot #5806/0715 0.5 mg/ml, used at final dilution of 1:50)
- Blocking buffer (FACS buffer:FcR blocker=24:1)
- Fixation buffer (1% PFA in PBS)
- Abs (FITC-anti-mouse CD3 (eBioscience 11-0031-82), PE-anti-mouse CD4 (eBioscience 12-0042-82), APC-C7-anti-mouse CD8 (BioLegend 100 714), and APC-anti-mouse CD19 (BioLegend 115512))

Methods:

Cell samples that were subjected to transduction with pFB vector containing the anti-CD206 CAR and T2A+mtrCD19 (2284_mt19 or 538_mt19), the anti-Fn14 CAR and T2A+ mtrCD19 (4A8H_mt19, 4A8L_mt19, 3G5H_mt19, 3G5L_mt19), or just the T2A+mtrCD19 (mt19) construct (from Day 8 of Example 1) were harvested and resuspended to $2.5\times10^6$ cells/ml in FACS buffer. $0.25\times10^6$ cells in 100 μL were placed in a 96 well round bottom plate and spun at 500 ref for 2 min, and the supernatant was removed. Cells in each well were resuspended in 25 μL of blocking buffer and incubated on ice for 10 min. Meanwhile, Ab mixture was made so that the final dilution of the Ab, when added to the cells, would match the manufacturer's suggestion.

Each well was added with 25 μL of the appropriate Ab mix and was incubated on ice in dark for 30 min. Cells were then added with 200 μL of FACS buffer and spun at 500 ref for 2 min, and the supernatant was removed. This washing step was repeated once more.

For the same day FACS analysis, cells in each well were resuspended in 250 μL of FACS buffer and analyzed on flow cytometer. For the next day analysis, cells were diluted in Fixation buffer until analyzed the following day. Cells were stored on ice or 4° C., protected from light, until run on FACS machine.

Results:

The representative results of three independent experiments are summarized in Table 3. As shown in Table 3, significant portions of transduced cells, within both the $CD3^+CD4^+$ and $CD3^+CD8^+$ cell populations, were stained positive for CD19.

TABLE 3

CD19 Flow cytometry results (unit: %)

| Parent population | $CD3^+$ live | $CD4^+$ $CD3^+$ | $CD8^+$ $CD3^+$ | $CD19^+$ $CD3^+CD4^+$ | $CD19^+$ $CD3^+CD8^+$ |
|---|---|---|---|---|---|
| mt19 | 99.3 | 47.9 | 44.1 | 9.7 | 5.5 |
| 538_mt19 | 99.4 | 57.2 | 35.8 | 23.6 | 18.6 |
| 2284_mt19 | 99.6 | 56.2 | 37.2 | 19.5 | 26.1 |
| 4A8L_mt19 | 98.7 | 34.1 | 57.9 | 17.8 | 7.4 |
| 4A8H_mt19 | 99.1 | 56.9 | 27.8 | 13.6 | 5.7 |
| 3G5L_mt19 | 99.4 | 58.9 | 29.9 | 14.6 | 9.1 |
| 3G5H _mt19 | 98.7 | 29.3 | 59.9 | 12.8 | 4.2 |

2-2: Anti-CD206 CAR Expression Test Using Recombinant CD206

Reagents:

FACS buffer (1% FBS in PBS)

FcR blocker (purchased from Dartmouth IML Core Lab, BXL 2.4G2 Lot #5806/0715 0.5 mg/ml, used at final dilution of 1:50)

Blocking buffer (FACS buffer:FcR blocker=24:1)

Fixation buffer (1% PFA in PBS)

Recombinant mouse MMR/CD206 (R&D Systems 2535-MM-050-CF, with a C-terminal 6-His tag)

Abs (PE-anti-His Tag (R&D Systems, IC050P), APC-anti-mouse CD19 (Biolegend, Cat No. 115512), FITC-anti-mouse CD3 (eBioscience, Cat No. 11-0031-82))

Methods:

Cell samples that were subjected to transduction with pFB vector containing the anti-CD206 CAR and T2A+mtrCD19 (2284_mt19) or containing just the T2A+mtrCD19 (mt19) construct (from Day 8 of Example 1) were harvested and resuspended to $2.5\times10^6$ cells/ml in FACS buffer. $0.25\times10^6$ cells in 100 μL were placed in a 96 well round bottom plate and spun at 500 ref for 1 min at room temperature, and the supernatant was removed. Cells in each well were resuspended in 25 μL of Blocking buffer and incubated on ice for 10 min.

Each well was added with 50 μL of recombinant mouse MMR/CD206 (2.5 μL/50 μL) or 50 μL of just FACS buffer, and was incubated on ice in dark for 60 min. Cells were then added with 100 μL of FACS buffer and spun at 500 ref for 1 min, and the supernatant was removed. This washing step was repeated once more. Meanwhile, Ab mixture (FITC-anti-CD3, APC-anti-CD19, and PE-anti-His Tag, with the final volume of 50 μL in FACS buffer per well) was made so that the final dilution of the Ab, when added to the cells, would match the manufacturer's suggestion.

As the second staining step, cells were added with 50 μL of the Ab mix and incubated on ice in dark for 30 min. Cells were then added with 150 μL of FACS buffer and spun at 500 ref for 1 min, and the supernatant was removed. This washing step was repeated once more with 200 μL of FACS buffer.

For the same day FACS analysis, cells in each well were resuspended in 250 μL of FACS buffer and analyzed on flow cytometer. For the next day analysis, cells were diluted in 250 μL of Fixation buffer until analyzed the following day. Cells were stored on ice or 4° C., protected from light, until run on FACS machine.

Cells transduced with the virus containing just the T2A+mtrCD19 (mt19) construct were used as the negative control.

Results:

The representative results of three independent experiments are summarized in Table 4. As shown in Table 4, significant portions of transduced cells were stained positive using recombinant CD206.

TABLE 4

CD206 CAR Flow cytometry results (unit: %)

| Parent population | $CD3^+$ live | $CD4^+$ $CD3^+$ | $CD8^+$ $CD3^+$ | $CD19^+$ Live | anti-CD206 CAR live |
|---|---|---|---|---|---|
| mt19 | 99.7 | 28.3 | 67.7 | 27.4 | 2.1 |
| 2284_mt19 | 99.7 | 39.8 | 55 | 37.2 | 20.9 |

2-3: Anti-Fn14 CAR Expression Test Using Recombinant Fn14

Reagents:

FACS buffer (1% FBS in PBS)

FcR blocker (purchased from Dartmouth IML Core Lab, BXL 2.4G2 Lot #580610715 0.5 mg/ml, used at final dilution of 1:50)

Blocking buffer (FACS buffer:FcR blocker=24:1)

Fixation buffer (1% PFA in PBS)

FITC-recombinant mouse Fn14:human Fc (ENZO ALX-522-036F)

APC-anti-mouse CD19 Ab (Biolegend, Cat No. 115512)

Methods:

Cell samples that were subjected to transduction with pFB vector containing the anti-Fn14 CAR and T2A+mtrCD19 (4A8H_mt19, 4A8L_mt19, 3G5H_mt19, 3G5L_mt19) construct or just the T2A+mtrCD19 (mt19) construct (from Day 8 of Example 1) were harvested, and $0.25\times10^6$ cells in 100 μL of FACS buffer were placed in a 96 well round bottom plate. The plate was spun at 500 ref for 1 min at room temperature, and the supernatant was removed. Cells in each well were resuspended in 25 μL of Blocking buffer and incubated on ice for 10 min.

Each well was added with 50 μL of FITC-recombinant mouse Fn4:human Fc (2.5 μL/50 μL) and APC-anti-CD19 (dilution as suggested by the manufacturer), and was incubated on ice in dark for 30 min. Cells were then added with 150 μL of FACS buffer and spun at 500 ref for 2 min, and the supernatant was removed. This washing step was repeated once more with 200 μL of FACS buffer.

For the same day FACS analysis, cells in each well were resuspended in 250 μL of FACS buffer and analyzed on flow cytometer. For the next day analysis, cells were diluted in 250 μL of Fixation buffer until analyzed the following day. Cells were stored on ice or 4° C., protected from light, until run on FACS machine.

Cells transduced with the virus containing just the T2A+mtrCD19 (mt19) construct were used as the negative control.

Results:

The representative results of three independent experiments are summarized in Table 5. As shown in Table 5, significant portions of anti-Fn CAR transduced cells were stained positive using FITC-recombinant Fn14. Cells transduced with pFB vector only containing the mtrCD19 but no CAR construct were stained positive for CD19 but showed only minimal staining with FITC-recombinant Fn14.

TABLE 5

Anti-Fn14 CAR flow cytometry results (unit %)

| Parent population | $CD4^+$ $CD3^+$ | $CD8^+$ $CD3^+$ | $CD19^+$ $CD3^+$ | anti-Fn14 $CAR^+$ $CD3^+$ |
|---|---|---|---|---|
| mt19 | 27.4 | 67.3 | 10.3 | 1.6 |
| 4A8L_mt19 | 20.8 | 74.5 | 12.0 | 9.0 |
| 4A8H_mt19 | 30.3 | 64.2 | 12.9 | 9.4 |
| 3G5L_mt19 | 33.3 | 61.5 | 12.1 | 11.4 |
| 3G5H_mt19 | 16.7 | 77.9 | 14.8 | 10.8 |

Example 3: In Vitro Functional Activity of Anti-Fn14 CARs and Anti-CD206 CARs—IFN γ Production by Plate-Bound Antigen

3-1: IFN γ ELISA to Test Anti-CD206 CAR Response Against Plate-Bound CD206

Reagents:

- Recombinant mouse MMR/CD206 (R&D Systems 2535-MM-050-CF, with a C-terminal 6-His tag)
- 96 well high binding ELISA plate (Nunc)
- Mouse IFN γ ELISA kit (R&D systems)

Methods:

Recombinant mouse MMR/CD206 was diluted in PBS at appropriate concentrations and allocated in wells of an ELISA plate. The recombinant mouse MMR/CD206 concentration in each well was either 100, 30, 10, 3, 1, 0.3, 0.1, 0.03, or 0 ng/100 μL/well. The plate was sealed and incubated overnight at 4° C. The next morning, each well on the plate was washed 3 times with 200 μL of PBS.

Cell samples that were subjected to transduction with pFB vector containing the anti-CD206 CAR and $T2A^+$mtrCD19 (22.84_mt19) construct or just the $T2A^+$mtrCD19 construct (mt19) (from Day 8 of Example 1) were resuspended in complete RPMI without IL-2 to $1\times10^6$ cells/ml, 100 μL of the cell suspension was placed in appropriate wells, and 100 μL of RPMI was added to each well. Cells were cultures for 22-25 hours at 37° C. and spun at 500 ref for 5 min, and 100 μL of supernatant from each well was harvested in a 96 well plate and stored sealed in a freezer until use.

Mouse IFN γ ELISA was performed following the manufacturer's instruction. Briefly, wells on an ELISA plate were coated with 100 μL/well of capture Ab, and were incubated overnight, sealed, at room temperature. Next morning, wells were emptied and blotted, and washed with 200 μL of wash buffer (0.05% Tween 20 in PBS). This wash step was repeated twice more. Wells were blocked with 200 μL/well of blocking buffer (1% BSA in PBS), sealed, and let sit at room temperature for at least 1 hour. Meanwhile, appropriate reagent dilution was performed to prepare Standard curve. Supernatant samples were also thawed diluted with diluent reagent (supernatant:diluent reagent=1:4).

Wells were washed with 200 μL/well wash buffer three times, added with diluted supernatant samples, and incubated at room temperature for 2 hours.

Wells were washed with 200 μL/well wash buffer three times, added with 100 μL of detection Ab, added with diluent reagent (detection Ab:diluent reagent=1:60, v:v), and incubated at room temperature for 2 hours.

Wells were washed with 200 μL/well wash buffer three times, added with 100 μL of streptavidin-HRP (1:40 dilution in diluent reagent), and incubated at room temperature for 20 min in dark.

Wells were washed with 200 μL/well wash buffer three times, added with 100 μL of 1:1 mixture of substrate A and B together, and incubated in dark for 10-20 min until the Standard curve wells turn blue. The reaction was stopped using the stop solution (2N H2SO4) and the plate was analyzed on a plate reader at 450 nm and 570 nm. Readings at 570 nm was subtracted from the readings at 450 nm.

Cells transduced with the virus containing just the T2A+ mtrCD19 (mt19) construct were used as the negative control Results:

The representative results of three independent experiments are summarized in FIG. 10A. Mean+/−sdv. Anti-CD206 CAR (2284_mt19) transduced cells, but not mock transduced cells (mt19), showed dose-dependent IFN-γ production upon exposure to recombinant CD206.

3-2: IFN γ ELISA to Test Anti-Fn14 CAR Response Against Plate-Bound Fn14

Reagents:

- FITC-recombinant mouse Fn14:human Fc (ENZO ALX-522-036F)
- 96 well high binding ELISA plate (Nunc)
- Mouse IFN γ ELISA kit (R&D systems)

Methods:

FITC-recombinant mouse Fn14:human Fc was diluted in PBS at appropriate concentrations and allocated in wells of an ELISA plate. FITC-recombinant mouse Fn14:human Fc concentration in each well was either 100, 30, 10, 3, 1, 0.3, 0.1, 0.03, or 0 ng/100 μL/well. The plate was sealed and incubated overnight at 4° C. The next morning, each well on the plate was washed 3 times with 200 μL of PBS.

Cell samples that were subjected to transduction with pFB vector containing the anti-Fn14 CAR construct (4A8H_mt19, 4A8L_mt19, 3G5H_mt19, or 3G5L_mt19) (from Day 8 of Example 1) were resuspended in complete RPMI without IL-2 to 1×10^6 cells/ml, 100 μL of the cell suspension was placed in appropriate wells, and 100 μL of RPMI was added to each well. Cells were cultures for 22-25 hours at 37° C. and spun at 500 ref for 5 min, and ~100 μL of supernatant from each well was harvested in a 96 well plate and stored sealed in a freezer until use.

Mouse IFN γ ELISA was performed following the manufacturer's instruction, as described in Example 3, Experiment 3-1.

Cells transduced with the virus containing just the T2A+ mtrCD19 (mt19) construct were used as the negative control.

Results:

The representative results with 4A8H_mt19, 3G5H_mt19, and mt19 of three independent experiments are summarized in FIG. 10B. Mean+/−sdv. Anti-Fn14 CAR (4A8H_mt19 or 3G5H_mt19) transduced cells, but not mock transduced cells (mt19), showed dose-dependent IFN-γ production upon exposure to the recombinant Fn14. Similar results were obtained using 4A8L_mt19 and 3G5L_mt19 (data not shown).

Example 4: In Vitro Functional Activity of Anti-Fn14 CARs and Anti-CD206 CARs-Cytokine Production by Cell-Cell Contact Assay 4-1: IFN γ Production Upon Exposure to Target Cells Using ELISA Methods:

Cell samples that were subjected to transduction with pFB vector containing the anti-CD206 CAR and T2A+mtrCD19 (22.84_mt19), anti-Fn14 CAR and T2A+mtrCD19 (4A8H_mt19 or 3G5H_mt19) construct, or just the T2A+ mtrCD19 (mt19) construct (from Day 8 of Example 1) were resuspended in complete RPMI without IL-2 to $1\times10^6$ cells/ml, and 100 μL of the cell suspension was placed in appropriate wells on a round bottom 96 well plate. Target cells were harvested, washed with HBSS, and resuspended in complete RPMI without IL-2 to $1\times10^{-6}$ cells/ml, and 100 μL of the target cell suspension was placed in appropriate wells. 3T3 cells, Caki cells, and Igrov cells were used as $Fn14^+$ target cells, and Bone marrow cells cultured with G-CSF for 5 days (BM) were used as $CD206^+$ target cells. Wells that do not contain both transduced cells and target cells were also brought up to the total volume of 200 μL using complete RPML The plate was incubated for 22-25 hours at 37° C. and spun at 500 ref for 5 min, and ~100 μL of supernatant from each well was harvested in a 96 well plate and stored scaled in a freezer until use.

Mouse IFN γ ELSA was performed following the manufacturer's instruction, as described in Example 3, Experiment 3-2.

Results:

The representative results with 2284_mt19, 4A8H_mt19, 3G5H_mt19, and mt19 of three independent experiments are summarized in FIG. 11. Mean+/−sdv. Anti-CD206 CAR (2284_mt19) transduced cells, but not anti-Fn14 CAR (4A8H_mt19 or 3 G5H_mt19) or mock (mt19) transduced cells, produced IFN-γa upon exposure to CD206+ target cells (BM cells). On the other hand, anti-Fn14 CAR (4A81_mt19 or 3G5H_mt19) transduced cells, but not anti-CD206 CAR (2284_mt19) or mock (mt19) transduced cells, produced IFN-γ upon exposure to the $Fn14^+$ target cells (3T3 cells and Caki cells). Similar results were obtained using Igrov cells, another $Fn14^+$ cells as the target (data not shown). Similar results were also obtained with anti-Fn14 CAR (4A8L_mt19 or 3G5L_mt19) transduced cells (data not shown).

4-2: Cytokine Production Upon Exposure to Target Cells Using Multiplex Analysis.

Supernatants harvested in 4-1 are further used to assess the production of multiple cytokines, IFN γ, IL-2, TNF α, GM-CSF, IL-10, IL-13, IL-5, and TGF β, by multiplex analysis.

Example 5: In Vitro Functional Activity of Anti-Fn14 CARs and Ant-CD206 CARs—Cytotoxicity Assay Cell samples that were subjected to transduction with pFB vector containing the anti-CD206 CAR and T2A+mtrCD19 (22.84_mt19), anti-Fn14 CAR and T2A+mtrCD19 (4A81_mt19 or 3G5H_mt19) construct, or just the T2A+ mtrCD19 (mt19) construct (from Day 8 of Example 1) are resuspended in complete RPMI without IL-2 to $1\times10^6$ cells/ml, and 100 μL of the cell suspension is placed in appropriate wells on a round bottom 96 well plate. Luciferase-labeled target cells are harvested, washed with HBSS, and resuspended in complete RPMI without IL-2 to $1\times10^6$ cells/ml, and 100 μL of the target cell suspension is placed in appropriate wells. Luciferase-labeled 3T3 cells, Caki cells, and Igrov cells re used as $Fn14^+$ target cells, and Bone marrow cells cultured with G-CSF for 5 days (BM) are used as CD206 target cells. Wells that do not contain both transduced cells and target cells are also brought up to the total volume of 200 μL using complete RPMI. Cytotoxicity is measured using a luciferase-based assay at appropriate time points.

Example 6: In Vivo Functional Activity of Anti-Fn14 CARs and Anti-CD206 CARs—SSc Mouse Model 6-1: Disease Model Selection:

Using gene-expression analyses, Inventors previously identified distinct molecular subsets among SSc patients (Milano, A., et al., "Molecular subsets in the gene expression signatures of scleroderma skin. PLoS ONE, 2008. 3(7): p. e2696; Pendergrass, S. A., et al., "Intrinsic gene expression subsets of diffuse cutaneous systemic sclerosis are stable in serial skin biopsies", *J Invest Dermatol,* 2012. 132(5): p. 1363-73; Sargent, J. L., et al., "A TGFβ-responsive gene signature is associated with a subset of diffuse scleroderma with increased disease severity", *J Invest Dermatol,* 2010. 130(3): p. 694-705; Sargent, J. L., et al., "A TGFβ-responsive gene signature is associated with a subset of diffuse scleroderma with increased disease severity", *J Invest Dermatol,* 2009. 130(3): p. 694-705; Chung, L., et al., "Molecular framework for response to imatinib mesylate in systemic sclerosis", *Arthritis Rheum,* 2009. 60(2): p. 584-91). The subsets were named the inflammatory, fibroproliferative, limited, and normal-like subsets; each containing patients that are molecularly distinct but are clinically indistinguishable (Johnson, M. E., P. A. Pioli, and M. L. Whitfield, "Gene expression profiling offers insights into the role of innate immune signaling in SSc", *Semin Immunopathol,* 2015. 37(5): p. 501-9; Sargent, J. L., et al., "A TGFβ-responsive gene signature is associated with a subset of diffuse scleroderma with increased disease severity", *J Invest Dermatol,* 2010. 130(3): p. 694-705; Sargent, J. L., et al., "A TGFβ-responsive gene signature is associated with a subset of diffuse scleroderma with increased disease severity", *J Invest Dermatol,* 2009. 130(3): p. 694-705; Sargent, J. L., et al., "Identification of Optimal Mouse Models of Systemic Sclerosis by Interspecies Comparative Genomics", *Arthritis Rheumatol,* 2016. 68(8): p. 2003-15). The characteristics of different subsets were confirmed in all SSc affected organs analyzed (skin, lung, esophagus, stomach, duodenum, PBMCs) (Mahoney J M et al., "Systems level analysis of systemic sclerosis shows a network of immune and profibrotic pathways connected with genetic polymorphisms", *PLoS Comput Biol.* 2015 Jan. 8; 11(1):e1004005, doi: 10.1371/journal.pcbi.1004005.eCollection 2015 January; Taroni, J. N., et al., "A novel multi-network approach reveals tissue-specific cellular modulators of fibrosis in systemic sclerosis", *Genome Med,* 2017. 9(1): p. 27)

Multi-tissue bioinformatics analyses have indicated that alternatively activated MPs are a driver of SSc in multiple target organs (Taroni, J. N., et al., "A novel multi-network approach reveals tissue-specific cellular modulators of fibrosis in systemic sclerosis", *Genome Med,* 2017. 9(1): p. 27). The preliminary data suggest that alternatively activated MPs in SSc produce factors such as IL-6 and TGF-β that drive the disease, and co-culture studies have shown that SSc-derived MPs activate dermal fibroblasts (unpublished data). These results implicate that alternatively activated MPs are key drivers of SSc pathogenesis and targeting the alternatively activated MPs would ameliorate fibrosis in the patients.

The inventors also performed a comparative genomic study using five different mouse models of SSc to identify the mouse models that best represent SSc at the molecular level (Sargent, J. L., et al., "Identification of Optimal Mouse Models of Systemic Sclerosis by Interspecies Comparative Genomics", *Arthritis Rheumatol,* 2016. 69(8): p. 2003-15). Inventors found that scIGVHD (Greenblatt, M. B., et at, "Interspecies Comparison of Human and Murine Scleroderma Reveals IL-13 and CCL2 as Disease Subset-Specific Targets", *Am J Pathol,* 2012), bleomycin (Sargent, J L., et al., "Identification of Optimal Mouse Models of Systemic Sclerosis by Interspecies Comparative Genomics", *Arthritis Rheumatol,* 2016. 68(8): p. 2003-15), and Tsk2/+ (Long, K. B., et al., "The Tsk2/+ mouse fibrotic phenotype is due to a gain-of-function mutation in the PIIINP segment of the Col3a1 gene", *J Invest Dermatol,* 2015. 135(3): p. 718-27) represent different subsets of SSc patients and that the bleomycin model clearly represents both the inflammatory and fibrotic subsets that we expect are good targets of Inventors' treatment. Accordingly, the bleomycin-induced SSc model is the first model to be tested in this experiment.

6-2: SSc Induction and CAR Cell Treatment

Methods:

7-Day Bleomycin Model

Eight-week-old C57B16 mice were subcutaneously injected at three sites per mouse with 0.1 ml of phosphate buffered saline (PBS) or bleomycin (0.1 mg/ml) daily for 7 days starting on Day 0 for SSc induction. On Day 2, SSc mice were intradermally administered at three sites per mouse (i.e., one administration site per one bleomycin site) with HBSS or 5×10 mouse T cells transduced with a vector with a control construct or a CAR construct as prepared in Example 1 in HBSS. The constructs used were pFB.mt19 for the control, pFB.mCAR2284_mt19 for anti-CD206 CAR, and pFB.mCAR4A8H_mt19 for anti-Fn14 CAR. On Day 7, mice were euthanized and the skin was harvested for analysis. 21-day bleomycin model Eight-week-old C57BL/6 mice were subcutaneously injected at three sites per mouse with 0.1 ml of PBS or bleomycin (0.1 mg/ml) daily for 21 days starting on Day 0 for SSc induction. On Day 0, mice were intradermally administered at three sites per mouse (i.e., one administration site per one bleomycin site) with HESS or $5\times10^{6}$ mouse T cells transduced with a vector with a control construct or a CAR construct as prepared in Example 1 in HBSS. The constructs used were pFB.mt19 for the control, pFB.mCAR2284_mt19 for anti-CD206 CAR, and pFB.mCAR4A8H_mt19 for anti-Fn14 CAR. On Day 21, mice were euthanized and the skin was harvested for analysis.

6-3: Dermal Thickness Assessment—Histological Analysis

Methods:

Harvested skin samples were preserved in 10% neutral buffered formalin for histological analysis. Formalin-fixed tissue was embedded in paraffin, and sections were cut and H&E stained for histological evaluation.

Using the H&E stained sections, dermal thicknesses were determined by measuring the distance from the basement membrane to the hypodermis in five different high-power fields per section, in two different sections per skin sample. Adipose tissue thicknesses were also measured. To determine thicknesses, 10 sites were selected along each tissue section, each thickness was calculated based on the number of pixels on Image J (National Institute of Health), and 10 thicknesses were averaged. One-way ANOVA was used to test the statistical significance of the differences between groups.

Results:

Representative H&E staining of the skin sections from mice without SSc induction (PBS Control), SSc mice (SSc induced using the 7-daybleomycin model) administered with HBSS (Bleomycin Control), SSc mice administered with control CAR T cells (Control CAR), and SSc mice administered with anti-CD206 CART cells (anti-CD206 CAR) are shown in FIG. 15A.

Representative dermal thickness (top) and adipose tissue thickness (bottom) comparisons in the 21-day bleomycin model are shown in FIG. 15B. As shown in the graph, anti-CD206 CAR T treatment was able to reduce the dermal and adipose thicknesses, to the levels that are statistically not different from or even below the levels in the non-fibrotic control mice (PBS). Anti-Fn14 CAR T treatment was also able to reduce the adipose tissue thickness.

6-4: Confirmation of CD206 Positive MP Targeting—Flow Cytometry

Methods:

To validate the efficiency of targeting by CAR, collected skin samples were digested and stained with a multi-color flow panel that Inventors have used previously to identify alternatively activated MPs (Ball, M. S., et al., "CDDO-Me Redirects Activation of Breast Tumor Associated Macrophages", *PLoS One,* 2016. 11(2): p. e0149600). One-way ANOVA was used to test the statistical significance of the differences between groups.

Results:

The graphs in FIGS. 16A and 16B respectively show the comparison of % CD206+ cells among live CD45+ cells in the skin from the 7-day bleomycin model (FIG. 16A) and the 21-day bleomycin model (FIG. 16B). The two graphs in FIG. 16B are derived from two independent experiments. Anti-CD206 CAR T cell treatment was indeed able to reduce the percentage of the target cells in the skin. Particularly of note, the % CD206+ cells were reduced to the level that is not significantly different from that of non-fibrotic mice (PBS) in the 7-day model. Interestingly, FIG. 16B (bottom) indicates that anti-Fn14 CART treatment also has tendency to reduce % CD206+ cells.

6-5: Gene Expression Analysis—Microarray

Methods:

To analyze the changes in gene expression elicited by CAR treatment according to the present invention, RNA was isolated from the collected skin samples and subjected to microarray expression analysis. The obtained data were applied to (i) differential gene expression and functional enrichment analyses and (ii) differential pathway expression analyses, as described below.

Microarray Data Pre-Processing

Non-median centered probe-level expression data from 27,077 unique probes were imputed for missing values and collapsed to unique genes (resulted in 14,948 genes) using mouse Agilent 8×60 K CHIP file via GenePattern (Reich M, Liefeld T, Gould J, Lerner J, Tamayo P, Mcsirov J P. GenePattern 2.0. Nat Genet. 2006 May; 38(5):500-1), followed by median-centering by genes via Cluster 3.0 (de Hoon M J, Inoto S, Nolan J, Miyano S. Open source clustering software. Bioinformatics. 2004 Jun. 12; 20(9): 1453-4).

Differential Gene Expression and Functional Enrichment Analyses

Differentially expressed genes (DEGs) were identified among 14,948 tested genes via GenePattern module ComparativeMarkerSelection (Gould J, Getz G, Monti S, Reich M, Mesirov J P. Comparative gene marker selection suite. Bioinformatics. 2006 Aug. 1; 22(15):1924-5). DEGs with feature p<0.05 (0 permutations, standard independent two-sample t-test) were treated as significant. Significant DEGs were evaluated for functional enrichment via g:Profiler (Reimand J, Kull M, Peterson H, Hansen J, Vilo J. g:Profiler—a web-based toolset for functional profiling of gene lists from large-scale experiments. Nucleic Acids Res. 2007 July; 35(Web Server issue):W193-200) vs. Gene Ontology (GO), KEGG and Reactome functional terms. Functional terms with p<0.05 (corrected for multiple testing via default g:SCS method) were treated as significant.

Differential Pathway Expression Analyses

Differentially expressed gene sets (pathways) were identified among 11,484 genes via Gene Set Enrichment Analysis (GSEA) (Subramanian A, Tamayo P, Mootha V K, Mukherjee S, Ebert B L, Gillette M A, Paulovich A, Pomeroy S L, Golub T R, Lander E S, Mesirov J P. Gene set enrichment analysis: a knowledge-based approach for interpreting genome-wide expression profiles. Proc Nat Acad Sci USA. 2005 Oct. 25; 102(43):15545-50) module in GenePattern ran vs. Hallmark database (Liberzon A, Birger C, Thorvaldsdóttir H, Ghandi M, Mesirov J P, Tamayo P. The Molecular Signatures Database (MSigDB) hallmark gene set collection. Cell Syst. 2015 Dec. 23; 1(6):417-425). Pathways with False Discovery Rate q-value <0.05 (gene set permutation) were treated as significant. Since GSEA utilizes gene sets with human gene symbols, mouse genes were mapped to their human orthologs via g:Orth orthology search, a part of g:Profiler.

Results:

The comparison of Fn14 mRNA expression levels among different groups in the 7-day bleomycin model is shown in FIG. 17A. Fn4 was downregulated in anti-CD206 CAR treated mice compared to the fibrotic animals that did not receive CAR treatment (belo). Similar Fn14 downregulation was also found in the 21-day bleomycin model with either anti-CD206 or anti-Fn14 CAR treatment, as indicated in the map shown in FIG. 17B.

Numerous genes were found to be differentially expressed (i.e., those genes are DEGs) in the 21-bleomycin model, and genes associated with particular functions among such DEGs were found to be significantly enriched. Genes with particular functions that were significantly enriched and also were significantly downregulated in the anti-CD206 and/or anti-Fn14 CAR treated groups are provided with p-values in Table 6.

TABLE 6

Significantly enriched downregulated GO terms

| Comparison | Significant GO terms (corrected p < 0.05) enriched in significant DEGs (raw p < 0.05); (number of DEGs for this GO term) |
|---|---|
| bleo vs. [bleo + anti-CD206 CAR] | Down in [bleo + anti-CD206 CAR]:<br>immune response (76), p = 0.0444<br>inflammatory response (41), p = 0.0165<br>cytokine secretion (22), p = 0.000928<br>cytokine production (46), p = 0.00108 |
| bleo vs. [bleo + anti-FN14 CAR] | Down in [bleo + anti-FN14 CAR]:<br>IFNG production (16), p = 0.00492 |
| [bleo + control CAR] vs. [bleo + anti-CD206 CAR] | Down in [bleo + anti-CD206 CAR]:<br>immune response (54), p = 0.00462<br>defense response (57), p = 0.000467<br>response to cytokine (40), p = 0.000555<br>collagen biosynthesis (8), p = 0.0414 |
| [bleo + control CAR] vs. [bleo + anti-FN14 CAR] | Down in [bleo + anti-FN14 CAR]:<br>immune response (63), p = 0.0000017<br>defense response (65), p = 0.000000292<br>response to cytokine (47), p = 0.000000247<br>cytokine production (29), p = 0.0496<br>extracellular matrix (26), p = 0.0362 |

Bleo=Bleomycin

FIGS. 18A and 18B provide the heat maps showing differential expression of genes particularly relevant to fibrosis among the GO terms from Table 6. FIG. 18A shows the differential expression of 54 genes assigned to the GO term of immune response (left) and of 8 genes assigned to collagen biosynthesis (right), comparing [bleo+control CAR] and [bleo+anti-CD206 CAR]. The 54 downregulated genes for immune response were Fam49b, Gsdmd, Nfkbia, S1c26a6, Stat5a, Oas2, Lgals1, Oas1f, Parp9, Oas1d, Sppl2b, Mcoln2, Dhx58, Oas1a, Herc6, Stat2, Rsad2, Eif2ak2, Ccl7, Trim30d, Rara, Mx2, Phf11a, Irgm1, Traf3ip2, Cd180, Lcp1, Enpp2, Clr1, B2m, H2-T23, Rif1, Trav6-3, Snx4, Gper1, Rpl13a, C3, Zbp1, Cd300a, Npff, Spon2, Oas11, Ptprc, Dtx31, Irf7, Bcl2, Esr1, Gbp7, Cxc11, Isg15, C1s1, Sp110, Ifit1, and Ifit3. The 8 downregulated genes for collagen biosynthesis were Pcolce, Col7a1, Col5a1, Col6a2, Col6a3, P3h3, Col27a1, and Col23a1. FIG. 18B shows the differential expression of 63 genes assigned to the GO term of immune response (left) and of 26 genes assigned to extracellular matrix (ECM) (right), comparing [bleo+control CAR] and [bleo+anti-Fn14 CAR]. The 63 downregulated genes for immune response were Mid2, Isg20, Ptx3, Pik3ap1, Cd300a, Tgfb3, Ntkbia, Clec2i, Stat5a, Fam49b, Tgfb1, Eif2ak2, Dhx58, Stat2, Rsad2, Oas2, Gsdmd, Bst2, Ccl7, Oas1s, Lgals1, Zbp1, Adar, Csk, Sppl2b, Herc6, Pml, Gbp3, Irgm1, Irgm2, Tgtp2, Parp9, Trim30a, Cd84, Cis1, Trim30d, Mx2, Ifit1, Isg15, Oas12, Oasl1, Spon2, C3, C1qb, Cd74, Phf11a, Gbp7, Ifit3, Clr1, H2-Q2, Oas1d, Sp110, Aqp4, Gapdh, Rpl13a, Iglv1, Ssc5d, Lax1, Clec4g, Iilr11, Irf7, Dtx31, and B12. The 26 downregulated genes for ECM were Adamts14, Entpd2, Thbs3, Col5a1, Col5a3, Spom2, Pcolce, Lox11, Tgfb1, Tnn, Tgfb3, Fln, Lmna, Adamts4, Tgm2, Hspa8, Efemp2, Col6a3, Lgals1, Cst3, Rps18, Gapdh, Col8a2, Il1r11, Lingo3, and Ssc5d. The color bar shown in FIG. 18A also applies to all other heat maps except for the map in FIG. 19A.

Gene Set Enrichment Analysis (GSEA) revealed that various gene sets (pathways) were differentially expressed by CAR treatment according to the present invention. Such pathways that were significantly downregulated are listed in Table 7, in the descending order of false discovery rate (FDR). i.e., IFNA response is the most significant pathway with decreased expression in the comparison of both "[bleo+control CAR] vs. [bleo+anti-CD206 CAR]" and "[bleo+control CAR] vs. [bleo+anti-FN14 CAR]".

All listed pathways are significant (FDR<5%). FIG. 19A provides the heat maps showing differential expression of pathways that were downregulated by CAR treatment according to the present invention, comparing [bleo+control CAR] and [bleo+anti-CD206 CAR] (top) and comparing [bleo+control CAR] and [bleo+anti-Fn14 CAR] (bottom).

TABLE 7

Significantly downregulated gene sets (pathways)

| Comparison | Significant GSEA Hallmark pathways (FDR q-value < 0.05) |
|---|---|
| bleo vs. [bleo + anti-CD206 CAR] | Down in [bleo + anti-CD206 CAR]:<br>ALLOGRAFT_REJECTION<br>INTERFERON_GAMMA_RESPONSE<br>INFLAMMATORY_RESPONSE |
| bleo vs. [bleo + anti-FN14 CAR] | Down in (bleo + anti-FN14 CAR]:<br>INTERFERON_GAMMA_RESPONSE<br>ALLOGRAFT_REJECTION<br>INTERFERON_ALPHA_RESPONSE<br>APICAL_SURFACE |
| [bleo + control CAR] vs. [bleo + anti-CD206 CAR] | Down in [bleo + anti-CD206 CAR]:<br>INTERFERON_ALPHA_RESPONSE<br>INTERFERON_GAMMA_RESPONSE<br>INFLAMMATORY_RESPONSE<br>IL6_JAK_STAT3_SIGNALING<br>ALLOGRAFT_ REJECTION<br>EPITHELIAL_MESENCHYMAL_TRANSITION<br>FATTY_ACID_METABOLISM<br>IL2_STAT5 _SIGNALING |
| [bleo + control CAR] vs. [bleo + anti-FN14 CAR] | Down in [bleo + anti-FN14 CAR]:<br>INTERFERON_ALPHA_RESPONSE<br>INTERFERON_GAMMA_RESPONSE<br>INFLAMMATORY_RESPONSE<br>ALLOGRAFT_REJECTION<br>IL6_JAK_STAT3_SIGNALING<br>EPITHELIAL_MESENCHYMAL_TRANSITION<br>MYOGENESIS<br>FATTY _ ACID _METABOLISM<br>IL2_STATS_SIGNALING |

Many of the pathways listed in Table 7 are relevant to treatment of fibrosis. Of note, GSEA revealed that the epithelial-mesenchymal transition (EMT) pathway was significantly decreased in expression in both the anti-CD206 CAR treated and anti-Fn14 CAR treated groups compared to the control CAR treated group. Interestingly, genes from the EMT pathway as found by GSEA showed the highest enrichment in ECM GO biological process according to g:Profiler in [bleo+anti-CD206 CAR] compared to [bleo+control CAR] (see FIG. 19B). Specifically, 24/49 EMT genes were annotated to ECM (p=5.96c-23).

The results obtained in Example 6 overall demonstrate strong therapeutic potential of the CAR constructs of the present invention and the methods using such CARs.

Example 7: Design and Synthesis of Constructs Containing Both CAR and GRX1 and Cells Expressing Both CAR and GRX1

7-1: Design of CAR+GRX1 Constructs

Vector constructs are designed for expressing one of the six exemplary CARS illustrated in FIG. 6 and GRX1 in the same cell. When expressing a CAR and GRX under the same promoter in cis using one vector, vectors may be designed to contain constructs as shown in FIGS. 12A and B, respectively using the IRES or T2A sequence between the CAR and GRX1. A vector encoding GRX1 but no CAR (FIGS. 12A and 12B, right most) and vectors encoding a CAR but no GRX1 is also used for comparison.

Additionally, vectors may also be designed for expressing one of the six exemplary CARs illustrated in FIG. 6 and GRX1 in the same cell by placing a CAR construct and GRX construct under separate promoters in one vector. CAG promotor may be appropriate for expressing GRX1.

Alternatively, a CAR construct and GRX1 construct may be contained in separate vectors for transducing cells using two or more different vectors.

7-2: Synthesis of Viruses

Retroviral vectors (such as pFB or SFG) containing the constructs described in 7-1 are used. This is performed in essentially the same procedures as described in Example 1, 1-2.

7-3: Titration of Viruses

This is performed in essentially the same procedures as described in Example 1, 1-3.

7-4: Stimulation of Mouse T Cells Using Concanavalin A (ConA), Transduction of Mouse T Cells with Virus Using IL-2 and Polybrene, Selection and Expansion, and Viability Assay.

This is performed in essentially the same procedures as described in Example 1, 1-4.

Example 8: GRX1 Expression and Secretion Tests 8-1: GRX1 Expression Test—Intracellular Staining and Flow Cytometry.

Reagents and Tools:

- PBS (without calcium and magnesium): Cellgro®, cat #21-040-CV
- FACs buffer (PBS+1% FBS (heat inactivated)): Atlanta Biologicals FBS cat #S11150H
- Permeabilization buffer: BD Biosciences, Perm/Wash™ Buffer, cat #554723
- Wash permeabilization buffer: 3 parts of Perm buffer+1 part of FACs buffer
- 96 well U bottom plates: Falcon, cat #3539
- Fixation buffer (1% paraformaldehyde (dilute from 20% EM grade in PBS)); Electron microscopy sciences, cat #15713-S—Electron microscopy sciences
- Polyclonal goat IgG, anti-mouse glutaredoxin 1 (as the primary Ab)—R&D systems cat #AF3119.
- Donkey PE-anti-goat IgG (as the secondary Ab)—Jackson Immuno Research cat #705-116-147.

Methods:

Cells are harvested, spun at 500 ref for 5 min at room temperature, washed twice with HBSS or PBS, counted, resuspended to $0.5\times10^6$ cells/100 μL in conical tube, added with 0.5 ml of Fixation buffer/100 μL of cells, and vortexed. Cells will then be incubated at room temperature for 10 minutes with intermittent vortex to maintain single cell suspension, and spun at 500 g for 5 minutes, and the Fixation buffer was removed. Cells are washed with PBS, spun at 500 g for 5 min, and resuspended in Wash permeabilization buffer at $5\times10^6$ cells/mi.

100 μL of cells is added to each well of a 96 well plate. For each sample, one well is for unstained sample, one well is for the secondary Ab only, and one or more (duplicates) wells are for anti-GRX1 Ab. The plate is spun at 500 g for 2 min, inverted and flicked to remove the supernatant, and intracellular staining is performed in saponin containing buffers as below.

Appropriate primary Ab in the total volume of 50 μL is added in Permeabilization buffer at a concentration desired. 50 μL of Permeabilization buffer is added to unstained and secondary only wells. Cells are incubated for 30 min at room temperature in dark. Cells in each well will then receive 150 μL of Wash permeabilization buffer, spun at 500 g for 2 min, and inverted and flicked to remove the supernatant. The wash procedure is repeated once more with 200 μL of Wash permeabilization buffer.

50 μL of secondary Ab at 1:100 in Permeabilization buffer is added to appropriate wells. 50 μL of Permeabilization buffer is added to the unstained well. Cells are incubated for 30 min at room temperature in dark. Cells in each well will then receive 150 μL of Wash permeabilization buffer, spun at 500 g for 2 min, and inverted and flicked to remove the supernatant. The wash procedure is repeated twice more with 200 μL of Wash permeabilization buffer.

Cells are resuspended in 250 μL of FACS buffer and analyzed by flow cytometry.

8-2: GRX1 Expression Test—Immunoblot.

Cell lysates are made and the expression of GRX1 is determined by immunoblot.

8-3: GRX1 Secretion Test—ELISA.

Example 9: GRX1 Functional Activity Test

Methods:

GRX1 functional activity is quantified using an in vitro enzymatic assay. A reaction containing 137 mM Tris-HCl (pH 8.0), 0.5 mM glutathione (GSH), 1.2 U glutathione disulfide (GSSH) reductase (Roche), 0.35 mM NADPH, 1.5 mM EDTA (pH 8.0), and 2.5 mM Cys-S03 is allowed to proceed at 30° C., and NADPH consumption is followed spectrophotometrically at 340 nm. The specific enzymatic reaction rate is obtained by subtracting the enzymatic rate that omits the substrate Cys-S03 from the enzymatic rate that expressed as units, where 1 unit equals the oxidation of 1 micro <NADPH/min/mg GRX1 (Reynaert, N. L., E. F. Wouters, and Y. M. Janssen-Heininger, Modulation of glutaredoxin-1 expression in a mouse model of allergic airway disease. Am J Respir Cell Mol Biol, 2007. 36(2): p. 147-51).

Example 10: In Vivo Functional Activity of Anti-Fn14 CARs and Anti-CD206 CARs—SSc Mouse Model Methods:

Experiments are performed in a similar manner as described in Example 6. The therapeutic potential is compared between CAR-expressing cells and cells expressing both CAR and GRX1.

Example 11: Persistence of In Vivo Administered Cells

An important parameter associated with both safety and potentially long-term protection is the persistence of responsive CAR T cells (Song et at Cancer Res 2011; 71:4617-4627).

Methods:

To measure persistence in vivo, SSc induction and cell (mock transduced cells, CAR-expressing cells, and cells expressing both CAR and GRX1) treatment are performed in a similar manner as described in Example 6, 6-2 (the cells are administered only on Day 9). The presence of CAR T cells at 14 and 28 days after administration of the cells is determined using q-PCR specific to the CAR. Tissue compartments to be analyzed will include blood, skin, bone marrow, lung, esophagus, stomach, duodenum, blood, bone marrow, and spleen. The amount of signal measured by q-PCR is used to estimate the relative number of CAR T cells present per tissue analyzed and provide a means to compare the survival and proliferative potential of the CAR variants.

Example 12: IL-37 Variant Significantly Increases IL-6 Production in Response to CpG Stimulation FIG. 14 shows an experiment result that demonstrates that IL-37 Rs2723187 variant increases IL-6 levels in response to CpG stimulation. Four different Hapmap immortalized B cell lines were stimulated with CpG for 72 hours. GM18500 and GM18501 are homozygous reference for rs2723187 (C/C; IL-37 Ref/Ref); GM18503 and GM18504 are heterozygous (C/T; IL-37 Ref/Var). IL-6 ELISA assay results show cell lines with the IL-37 SNP produce increased IL-6 ($p<0.01$) in response to CpG stimulation.

REFERENCES

1. Anathy, V., et al., "Redox amplification of apoptosis by caspase-dependent cleavage of glutaredoxin 1 and 5-glutathionylation of Fas", J Cell Biol, 2009. 184(2): p. 241-52.
2. Arron, S. T., et al., "High *Rhodotorula* sequences in skin transcriptome of patients with diffuse systemic sclerosis", J Invest Dermatol, 2014.134(8): p. 2138-45
3. Assassi, Shervin and Allanore, Yannick. "Genetic Factors Scleroderma: From Pathogenesis to Comprehensive Management", 2nd Ed. Varga, John et al., Springer, 2017 25-38. Google Books. Web. 15 Aug. 2017
4. Baeten, D., et al., "Association of CD163+ macrophages and local production of soluble CD163 with decreased lymphocyte activation in spondylarthropathy synovitis", Arthritis Rheum. 2004 May; 50(5): p. 1611-23.
5. Ball, M. S., et al., "CDDO-Me Redirects Activation of Breast Tumor Associated Macrophages", PLoS One, 2016. 11(2): p. e0149600
6. Benoit, M. et at, "Macrophage polarization in bacterial infections", J. Immunol. 2008; 181: 3733-3739.
7. Binnemars-Postma, K., Storm, G., and Prakash, J., "Nanomedicine strategies to target tumor-associated macrophages", Int J Mol Sci. 2017 May 4; 18(5).
8. Brooks, L., 3rd, et al., "A multiprotein occupancy map of the mRNP on the 3' end of histone mRNAs", RNA, 2015. 21(11): p. 1943-65
9. Chavez-Galan, L., et al., "Much more than M1 and M2 macrophages, there are also CD169(+) and TCR(+) macrophages", Front Immunol. 2015 May 26; 6: p. 263.
10. Chen, S., et al., "Fn14, a downstream target of the TGF-β signaling pathway, regulates fibroblast activation", PLoS One. 2015 Dec. 1; 10(12).
11. Chinetti-Gbaguidi, G., Colin, S., and Staels, B., "Macrophage subsets in atherosclerosis", Nat Rev Cardiol. 2015 January; 12(1): p. 10-7.
12. Christmann, R. B., et al., "Interferon and alternative activation of monocyte/macrophages in systemic sclerosis-associated pulmonary arterial hypertension", Arthritis Rheum, 2011. 63(6): p. 1718-28.
13. Chung, L., et al., "Molecular framework for response to imatinib mesylate in systemic sclerosis", Arthritis Rheum, 2009. 60(2): p. 584-91
14. Classen, A., Lloberas, J, and Celada, A., "Macrophage activation: classical versus alternative", Methods Mol Biol. 2009; 531: p. 29-43.
15. Coussens, L. M., and Werb, Z., "Inflammation and Cancer" Nature. 2002 Dec. 19-26; 420(6917): p. 860-7
16. Culp, P. A., et al., "Antibodies to TWEAK receptor inhibit human tumor growth through dual mechanisms", Clin Cancer Res. 2010 Jan. 15; 16(2): p. 497-508.

17. de Hoon M J, Imoto S, Nolan J, Miyano S. Open source clustering software. Bioinformatics. 2004 Jun. 12; 20(9): 1453-4. PMID: 14871861.

18. Elhai, M., et al., "Outcomes of patients with systemic sclerosis-associated polyarthritis and myopathy treated with tocilizumab or abatacept: a EUSTAR observational study", Ann Rheum Dis, 2013. 72(7): p. 1217-20.

19. Foguer, K., "Endostatin gene therapy inhibits intratumoral macrophage M2 polarization", Biomed Pharmacother. 2016 April; 79:102-11.

20. Gould J, Getz G, Monti S, Reich M, Mesirov J P. Comparative gene marker selection suite. Bioinformatics. 2006 Aug. 1; 22(15):1924-5. PMID: 16709585.

21. Greenblatt, M. B., et al., "Interspecies Comparison of Human and Murine Scleroderma Reveals IL-13 and CCL2 as Disease Subset-Specific Targets", Am J Pathol, 2012.

22. Haegel, et al., "A unique anti-CD115 monoclonal antibody which inhibits osteolysis and skews human monocyte differentiation from M2-polarized macrophages toward dendritic cells", MAbs. 2013 September-October; 5(5):736-47

23. Hashemy S I et al, "Oxidation and S-nitrosylation of cysteines in human cytosolic and mitochondrial glutaredoxins: effects on structure and activity", J Biol Chem. 2007 May 11; 282(19):14428-36. Epub 2007 Mar. 13.

24. Higashi-Kuwata N., et al., "Alternatively activated macrophages (M2 macrophages) in the skin of patient with localized scleroderma", Exp Dermatol. 2009 August; 18(8):727-9.

25. Higashi-Kuwata N., et al., "Characterization of monocyte/macrophage subsets in the skin and peripheral blood derived from patients with systemic sclerosis", Arthritis Res Ther. 2010; 12(4).

26. Itoigawa, Y., et al., "TWEAK enhances TGF-b-induced epithelial-mesenchymal transition in human bronchial epithelial cells", Respir Res. 2015 Apr. 8; 16:48.

27. Jian, Z., and Zhu, L., "Update on the role of alternatively activated macrophages in asthma", J Asthma Allergy, 2016 Jun. 3; 9: p. 101-7.

28. Johansson, C., "Human Mitochondrial Glutaredoxin Reduces S-Glutathionylated Proteins with High Affinity Accepting Electrons from Either Glutathione or Thioredoxin Reductase", J Biol Chem. 2004. Feb. 27: 279(9): p. 7537-43.

29. Johnes, J. T., et al., "Glutathione S-transferase pi modulates NF-κB activation and pro-inflammatory responses in lung epithelial cells", Redox Biol. 2016 August; 8:375-82.

30. Johnson, M. E., P. A. Pioli, and M. L. Whitfield, "Gene expression profiling offers insights into the role of innate immune signaling in SSc", Semin Immunopathol, 2015. 37(5): p. 501-9.

31. Kalos, M. et al. "T cells with chimeric antigen receptors have potent antitumor effects and can establish memory in patients with advanced leukemia", Sci Transl Med 3, 95ra73, doi:10.1126/scitranslmed.3002842 (2011).

32. Karo-Atar, D., et al., "A protective role for IL-13 receptor α1 in bleomycin-induced pulmonary injury and repair", Mucosal Immunology (2016) 9, 240-253

33. Kendall, R. T. and C. A. Feghali-Bostwick, "Fibroblasts in fibrosis: novel roles and mediators", Front Pharmacol, 2014. 5: p. 123

34. Khanna, D., et al., "Safety and efficacy of subcutaneous tocilizumab in adults with systemic sclerosis (faSSenate): a phase 2, randomised, controlled trial. Lancet, 2016. 387(10038): p. 2630-40

35. Kim, J. H., et al., "High cleavage efficiency of a 2A peptide derived from porcine teschovirus-1 in human cell lines, zebrafish and mice", PLoS One. 2011; 6(4)

36. Van Kuijk, A. W., et al. "TWEAK and its receptor Fn14 in the synovium of patients with rheumatoid arthritis compared to psoriatic arthritis and its response to tumour necrosis factor blockade", Ann Rheum Dis. 2010 January; 69(1):301-4.

37. Laria, A. et al., "The macrophages in rheumatic diseases", *J Inflamm Res.* 2016 Feb. 9; 9: p. 1-11.

38. Lee, E K., et al., "Decreased expression of glutaredoxin 1 is required for transforming growth factor-β1-mediated epithelial-mesenchymal transition of EpRas mammary epithelial cells", Biochem Biophys Res Commun, 2010.391(1): p. 1021-7.

39. Lian, C., et al., "The anti-fibrotic effects of microRNA-153 by targeting TGFBR-2 in pulmonary fibrosis", Exp Mol Pathol. 2015 October; 99(2):279-85

40. Libby, P., "Inflammation and cardiovascular disease mechanisms", Am J Clin Nutr. 2006 February; 83(2): p. 456S-460S 41. Liberzon A, Birger C, Thorvaldsdóttir H, Ghandi M, Mesirov J P, Tamayo P. The Molecular Signatures Database (MSigDB) hallmark gene set collection. Cell Syst. 2015 Dec. 23; 1(6):417-425. PMID: 26771021

42. Liu, T., et al., "FIZZ2/RELM-β Induction and Role in Pulmonary Fibrosis", J Immunol. 2011 Jul. 1; 187(1):450-61

43. Long, K. B., et al., "The Tsk2/+ mouse fibrotic phenotype is due to a gain-of-function mutation in the PIIINP segment of the Col3a1 gene", J Invest Dermatol, 2015. 135(3): p. 718-27

44. Luo, Y., et al., "Targeting tumor-associated macrophages as a novel strategy against beast cancer", J Clin Invest. 2006 August; 116(8): p. 2132-2141.

45. Madrigal-Matute, J., "TWEAK/Fn14 interaction promotes oxidative stress through NADPH oxidase activation in macrophages", Cardiovasc Res. 2015 Oct. 1; 108(1): p. 139-47.

46. Mahoney J M et al., "Systems level analysis of systemic sclerosis shows a network of immune and profibrotic pathways connected with genetic polymorphisms", PLoS Comput Biol. 2015 Jan. 8; 11(1):e1004005. doi: 10.1371/journal.pcbi.1004005. eCollection 2015 January 47. Martinez, F. O. and Gordon, S., "The M1 and M2 paradigm of macrophage activation: time for reassessment", F1000Prime Reports. 2014; 6: 1-13.

48. McMillan, D. H., et al., "Attenuation of lung fibrosis in mice with a clinically relevant inhibitor of glutathione-S-transferase pi", JCI Insight, 2016. 1(8).

49. Milano, A., et al., "Molecular subsets in the gene expression signatures of scleroderma skin", PLoS ONE, 2008. 3(7): p. e2696

50. Monteiro, R., and Azevedo, I., "Chronic inflammation in obesity and the metabolic syndrome", Mediators Inflamm. 2010; 2010.

51. Moreno J A, et al., "HMGB1 expression and secretion are increased via TWEAK-Fn14 interaction in atherosclerotic plaques and cultured monocytes", Arterioscler Thromb Vasc Biol 2013; 33:612-620, 52. Mortazavi, A., et al., "Mapping and quantifying mammalian transcriptomes by RNA-Seq. Nat Methods, 2008. 5(7): p. 621-8

53. Murray, L. A., et al., "TGF-β driven lung fibrosis is macrophage dependent and blocked by Serum amyloid P", Int J Biochem Cell Biol. 2011 January; 43(1): p. 154-62.

54. Murray, P. J., and Wynn, T. A., "Protective and pathogenic functions of macrophage subsets", Nat Rev Immunol. 2011 Oct. 14; 11(11): p. 723-37.
55. Murthy, et al., "Alternative activation of macrophages and pulmonary fibrosis are modulated by scavenger receptor, macrophage receptor with collagenous structure", FASEB J. 2015 August; 29(8):3527-36
56. Novoyatieva, T., et al., "Deletion of Fn14 receptor protects from right heart fibrosis and dysfunction", Basic Res Cardiol. 2013 March; 108(2): p325.
57. Padilla et al., "High-level expression of fully active human glutaredoxin (thioltransferase) in *E. coli* and characterization of Cys7 to Ser mutant protein", FEBS Lett. 1996 Jan. 2; 378(1):69-73.
58. Peltoniemi, M., et al., "Expression of glutaredoxin is highly cell specific in human lung and is decreased by transforming growth factor-β in vitro and in interstitial lung diseases in vivo", Hum Pathol. 2004 August; 35(8): 1000-7.
59. Peltoniemi, M. J., et al., "Modulation of glutaredoxin in the lung and sputum of cigarette smokers and chronic obstructive pulmonary disease", Respir Res. 2006 Oct. 25; 7:133.
60. Pendergrass, S. A., et al., "Intrinsic gene expression subsets of diffuse cutaneous systemic sclerosis are stable in serial skin biopsies", J Invest Dermatol, 2012. 132(5): p. 1363-73
61. Porter, D. L., et al., "Chimeric antigen receptor-modified T cells in chronic lymphoid leukemia", N Engl. J Med 365, 725-733, doi:10.1056/NEJMoal 103849 (2011).
62. Reich M, Liefeld T, Gould J, Lerner J, Tamayo P, Mesirov J P. GenePattern 2.0. Nat Genet. 2006 May; 38(5):500-1. PMID: 16642009.
63. Reimand J, Kull M, Peterson H, Hansen J, Vilo J. g:Profiler—a web-based toolset for functional profiling of gene lists from large-scale experiments. Nucleic Acids Res. 2007 July; 35(Web Server issue):W193-200. PMID: 17478515.
64. Reynaert, N. L., E. F. Wouters, and Y. M. Janssen-Heininger, "Modulation of glutaredoxin-1 expression in a mouse model of allergic airway disease", Am J Respir Cell Mol Biol, 2007. 36(2): p. 147-51
65. Rice, L. M., et al., "Fresolimumab treatment decreases biomarkers and improves clinical symptoms in systemic sclerosis patients", J Clin Invest, 2015. 125(7): p. 2795-807.
66. Robinson, M. D., D. J. McCarthy, and G. K. Smyth, "edgeR: a Bioconductor package for differential expression analysis of digital gene expression data", Bioinformatics, 2010. 26(1): p. 139-40
67. Sagemark, J., et al., "Redox properties and evolution of human glutaredoxins", Proteins, 2007 Sep. 1; 68(4): p. 879-92.
68. Sargent, J. L., et al., "A TGFβ-responsive gene signature is associated with a subset of diffuse scleroderma with increased disease severity", J Invest Dermatol, 2010. 130(3): p. 694-705
69. Sargent, J. L., et al., "A TGFβ-responsive gene signature is associated with a subset of diffuse scleroderma with increased disease severity", J Invest Dermatol, 2009. 130(3): p. 694-705
70. Sargent, J. L., et al., "Identification of Optimal Mouse Models of Systemic Sclerosis by Interspecies Comparative Genomics", Arthritis Rheumatol, 2016. 68(8): p. 2003-15
71. Schapira K, et al., "Fn14-Fc fusion protein regulates atherosclerosis in ApoE/mice and inhibits macrophage lipid uptake in vitro", Arterioscler Thromb Vase Biol (2009) 29:2021-7.
72. Serafini, B., "Expression of TWEAK and its receptor Fn14 in the multiple sclerosis brain: implications for inflammatory tissue injury", J Neuropathol Exp Neurol. 2008 December; 67(12): p. 1137-48.
73. Steen, V. D. and T. A. Medsger, "Changes in causes of death in systemic sclerosis, 1972-2002", Ann Rheum Dis, 2007. 66(7): p. 940-4.
74. Suarez, E. R., "Chimeric antigen receptor T cells secreting anti-PD-L1 antibodies more effectively regress renal cell carcinoma in a humanized mouse model", Oncotarget. 2016 Jun. 7; 7(23):34341-55.
75. Subramanian A, Tamayo P, Mootha V K, Mukherjee S, Ebert B L, Gillette M A, Paulovich A, Pomeroy S L, Golub T R, Lander E S, Mesirov J P. Gene set enrichment analysis: a knowledge-based approach for interpreting genome-wide expression profiles. Proc Natl Acad Sci USA. 2005 Oct. 25; 102(43):15545-50. PMID: 16199517
76. Taroni, J N., et al., "A novel multi-network approach reveals tissue-specific cellular modulators of fibrosis in systemic sclerosis", Genome Med, 2017. 9(1): p. 27.
77. Vendrell, J., and Chacon, M. R., "TWEAK: A new player in obesity and diabetes", Front Immunol. 2013 Dec. 30; 4:488.
78. Wang, B., et al., "Transforming growth factor-β1-mediated renal fibrosis is dependent on the regulation of transforming growth factor receptor 1 expression by let-7b", Kidney Int. 2014 February; 85(2):352-61
79. Wang, W., et al., "Reversible silencing of CFTR chloride channels by glutathionylation", J Gen Physiol, 2005 February; 125(2):127-41. Epub 2005 Jan. 18.
80. Williams, C. B., Yeh, E. S., and Soloff, A. C., "Tumor-associated macrophages: unwitting accomplishes in breast cancer malignancy", NPJ Breast Cancer. 2016; 2.
81. Wynn, T. A., and Ramalingam, T. R., "Mechanisms of fibrosis: fibrotic translation for fibrotic diseases", Nat Med, 2012 Jul. 6; 18(7): p. 1028-40.
82. Yang Y et al., "Reactivity of the human thioltransferase (glutaredoxin) C7S, C25S, C78S, C82S mutant and NMR solution structure of its glutathionyl mixed disulfide intermediate reflect catalytic specificity", Biochemistry. 1998 Dec. 8; 37(49):17145-56
83. Yang, Z. P., Kuo, C. C., and Grayston, J. T, "Systemic dissemination of *Chlamydia pneumoniae* following intranasal inoculation in mic", J Infect Dis. 1995 March; 171(3): p. 736-8.
84. Zhou, H., et al., "The TWEAK receptor Fn14 is a novel therapeutic target in melanoma: Immunotoxins targeting Fn14 receptor for malignant melanoma treatment", J Invest Dermatol. 2013 April; 133(4): p. 1052-62.

APPENDIX

| AMINO ACID AND NUCLEIC ACID SEQUENCES |
|---|
| Human CD206<br>(SEQ ID NO: 101) Protein sequence:<br>MRLPLLLVFASVIPGAVLLLDTRQFLIYNEDHKRCVDAVSPSAVQTAACNQDAESQKFRWVSESQI<br>MSVAFKLCLGVPSKTDWVAITLYACDSKSEFQKWECKNDTLLGIKGEDLFFNYGNRQEKNIMLYK<br>GSGLWSRWKIYGTTDNLCSRGYEAMYTLLGNANGATCAFPFKFENKWYADCTSAGRSDGWLWC<br>GTTTDYDTDKLFGYCPLKFEGSESLWNKDPLTSVSYQINSKSALTWHQARKSCQQQNAELLSITEI<br>HEQTYLTGLTSSLTSGLWIGLNSLSENSGWQWSDRSPFRYLNWLPGSPSAEPGKSCVSLNPGKNA<br>KWENLECVQKLGYICKKGNTTLNSFVIPSESDVPTHCPSQWWPYAGHCYKIHRDEKKIQRDALTT |

APPENDIX-continued

AMINO ACID AND NUCLEIC ACID SEQUENCES

CRKEGGDLTSIHTIEELDFIISQLGYEPNDELWIGLNDIKIQMYFEWSDGTPVTFTKWLRGEPSHE
NNRQEDCVVMKGKDGYWADRGCEWPLGYICKMKSRSQGPEIVEVEKGCRKGWKKHHFYCYMIG
HTLSTFAEANQTCNNENAYLTTIEDRYEQAFLTSFVGLRPEKYFWTGLSDIQTKGTFQWTIEEEV
RFTHWNSDMPGRKPGCVAMRTGIAGGLWDVLKCDEKAKFVCKHWAEGVTHPPKPTTTPEPKC
PEDWGASSRTSLCFKLYAKGKHEKKTWFESRDFCRALGGDLASINNKEEQQTIWRLITASGSYHK
LFWLGLTYGSPSEGFTWSDGSPVSYENWAYGEPNNYQNVEYCGELKGDPTMSWNDINCEHLNN
WICQIQKGQTPKPEPTPAPQDNPPVTEDGWVIYKDYQYYFSKEKETMDNARAFCKRNFGDLVSIQ
SESEKKFLWKYVNRNDAQSAYFIGLLISLDKKFAWMDGSKVDYVSWATGEPNFANEDENCVTMY
SNSGFWNDINCGYPNAFICQRHNSSINATTVMPTMPSVPSGCKEGWNFYSNKCFKIFGFMEEERK
NWQEARKACIGFGGNLVSIQNEKEQAFLTYHMKDSTFSAWTGLNDVNSEHTFLWTDGRGVHYT
NWGKGYPGGRRSSLSYEDADCVVIIGGASNEAGKWMDDTCDSKRGYICQTRSDPSLTNPPATIQT
DGFVKYGKSSYSLMRQKFQWHEAETYCKLHNSLIASILDPYSNAFAWLQMETSNERVWIALNSNL
TDNQYTWTDKWRVRYTNWAADEPKLKSACVYLDLDGYWKTAHCNESFYFLCKRSDEIPATEPP
QLPGRCPESDHTAWIPFHGHCYYIESSYTRNWGQASLECLRMGSSLVSIESAAESSFLSYRVEPLKS
KTNFWIGLFRNVEGTWLWINNSPVSFVNWNTGDPSGERNDCVALHASSGFWSNIHCSSYKGYIC
KRPKIIDAKPTHELLTTKADTRKMDPSKPSSNVAGVVIIVILLILTGAGLAAYFFYKKRRVHLPQEG
AFENTLYFNSQSSPGTSDMKDLVGNIEQNEHSVI

Human CD163
(SEQ ID NO: 102) Protein sequence:
MSKLRMVLLEDSGSADFRRHFVNLSPFTITVVLLLSACFVTSSLGGTDKELRLVDGENKCSGRVEV
KVQEEWGTVCNNGWSMEAVSVICNQLGCPTAIKAPGWANSSAGSGRIWMDHVSCRGNESALWD
CKHDGWGKHSNCTHQQDAGVTCSDGSNLEMRLTRGGNMCSGRIEIKFQGRWGTVCDDNFNIDH
ASVICRQLECGSAVSFSGSSNFGEGSGPIWFDDLICNGNESALWNCKHQGWGKHNCDHAEDAGVI
CSKGADLSLRLVDGVTECSGRLEVRFQGEWGTICDDGWDSYDAAVACKQLGCPTAVTAIGRVNAS
KGFGHIWLDSVSCQGHEPAVWQCKHHEWGKHYCNHNEDAGVTCSDGSDLELRLRGGGSRCAGT
VEVEIQRLLGKVCDRGWGLKEADVVCRQLGCGSALKTSYQVYSKIQATNTWLFLSSCNGNETSLW
DCKNWQWGGLTCDHYEEAKITCSAHREPRLVGGDIPCSGRVEVKHGDTWGSICDSDFSLEAASVL
CRELQCGTVVSILGGAHFGEGNGQIWAEEFQCEGHESHLSLCPVAPRPEGTCSHSRDVGVVCSRYT
EIRLVNGKTPCEGRVELKTLGAWGSLCNSHWDIEDAHVLCQQLKCGVALSTPGGARFGKGNGQI
WRHMFHCTGTEQHMGDCPVTALGASLCPSEQVASVICSGNQSQTLSSCNSSSLGPTRPTIPEESAV
ACIESGQLRLVNGGGRCAGRVEIYHEGSWGTICDDSWDLSDAHVVCRQLGCGEAINATGSAHFGE
GTGPIWLDEMKCNGKESRIWQCHSHGWGQQNCRHKEDAGVICSEFMSLRLTSEASREACAGRLE
VFYNGAWGTVGKSSMSETTVGVVCRQLGCADKGKINPASLDKAMSIPMWVDNVQCPKGPDTLW
QCPSSPWEKRLASPSEETWITCDNKIRLQEGPTSCSGRVEIWHGGSWGTVCDDSWDLDDAQVVC
QQLGCGPALKAFKEAEFGQGTGPIWLNEVKCKGNESSLWDCPARRWGHSECGHKEDAAVNCTDI
SVQKTPQKATTGRSSRQSSFIAVGILGVVLLAIFVALFFLTKKRRQRQRLAVSSRGENLVHQIQYRE
MNSCLNADDLDLMNSSGGHSEPH Human Fn14
(SEQ ID NO: 103) Protein sequence:
MARGSLRRLLRLLVLGLWLALLRSVAGEQAPGTAPCSRGSSWSADLDKCMDCASCRARPHSDFCL
GCAAAPPAPFRLLWPILGGALSLTFVLGLLSGFLVWRRCRRREKFTTPIEETGGEGCPAVALIQ Leader sequence (LS)
(SEQ ID NO: 105) Protein sequence:
MEWTWVFLELLSVTAGVHS (SEQ ID NO: 205) DNA sequence:
ATGGAGTGGACCTGGGTGTTCCTGTTCCTGCTGAGCGTGACCGCCGGCGTGCACAGC Anti-CD206 nanobody NbMMRm22.84
(SEQ ID NO: 110) Protein sequence (CDR1: underlined; CDR2: italic; CDR3: bold):
QVQLQESGGGLVQPGGSLRLSCAASGRTFSNYVNYAMGWFRQFPGKEREFVA*SISWSSVTT*YYADS
VKGRFTISRDNAKNTVYLQMNSLKPEDTAVYYCAAHLAQYSDYAYRDPHQFGAWGQGTQVTVS
S (SEQ ID NO: 210) DNA sequence:
CAGGTTCAGCTGCAAGAGTCTGGCGGAGGACTGGTTCAACCTGGCGGAAGCCTGAGACTGTCTTG
TGCCGCTTCTGGCAGAACCTTCAGCAACTACGTGAACTACGCCATGGGCTGGTTCAGACAGTTCC
CCGGCAAAGAGAGAGAGTTCGTCGCCAGCATCAGCTGGTCTAGCGTGACCACCTACTACGCCGAC
AGCGTGAAGGGCAGATTCACCATCAGCAGAGACAACGCCAAGAACACCGTGTACCTGCAGATGA
ACAGCCTGAAGCCAGAGGACACCGCCGTGTACTACTGTGCTGCTCACCTGGCTCAGTACAGCGAC
TACGCCTACAGAGATCCCCACCAGTTTGGCGCTTGGGGCCAGGGAACACAAGTGACCGTTAGCTC
T Anti-CD206 nanobody NbMMRm22.84 CDR1
(SEQ ID NO: 111) Protein sequence:
GRTFSNYVNYAMG Anti-CD206 nanobody NbMMRm22.84 CDR2
(SEQ ID NO: 112) Protein sequence:
SISWSSVTT Anti-CD206 nanobody NbMMRm22.84 CDR3
(SEQ ID NO: 113) Protein sequence:
HLAQYSDYAYRDPHQFGA APPENDIX-continued

AMINO ACID AND NUCLEIC ACID SEQUENCES

Anti-CD206 nanobody NbMMRm5.38
(SEQ ID NO: 114) Protein sequence (CDR1: underlined; CDR2: italic; CDR3: bold):
QVQLQESGGGLVQAGGSLRLSCAASGFTDDDYDIGWFRQAPGKEREGVS*CISSSDGST*YYADSVKG
RFTISSDNAKNTVYLQMNSLKPEDTAVYYCAADFFRWDSGSYYVRGCRHATYDYWGQGTQVTV
SS (SEQ ID NO: 214) DNA sequence:
CAGGTTCAGCTGCAAGAGTCTGGCGGAGGACTGGTTCAAGCTGGCGGAAGCCTGAGACTGTCTTG
TGCCGCTTCTGGCTTCACCGACGACGACTACGATATCGGCTGGTTCAGACAGGCCCCTGGCAAAG
AGAGAGAGGGCGTCAGCTGTATCAGCAGCTCTGACGGCTCTACCTACTACGCCGACAGCGTGAAG
GGCAGATTCACCATCAGCAGCGACAACGCCAAGAACACCGTGTACCTGCAGATGAACTCTCTGAA
GCCCGAGGACACCGCCGTGTACTACTGTGCCGCCGACTTCTTCAGATGGGACAGCGGCAGCTACT
ACGTGCGGGGATGTAGACACGCCACCTACGATTACTGGGGCCAGGGCACACAAGTGACCGTGTCA
TCT Anti-CD206 nanobody NbMMRm5.38 CDR1
(SEQ ID NO: 115) Protein sequence:
GFTDDDYDIG Anti-CD206 nanobody NbMMRm5.38 CDR2
(SEQ ID NO: 116) Protein sequence:
CISSSDGST Anti-CD206 nanobody NbMMRm5.38 CDR3
(SEQ ID NO: 117) Protein sequence:
DFFRWDSGSYYVRGCRHATYDY Anti-Fn14 antibody AbP4A8 heavy chain variable domain (P4A8VH)
(SEQ ID NO: 118) Protein sequence (CDR1: underlined; CDR2: italic; CDR3: bold):
QVQLQQSGPEVVRPGVSVKISCKGSGYTFTDYGMHWVKQSHAKSLEWIG*VISTYNGYTNYNQKFK*
*G*KATMTVDKSSSTAYMELARLTSEDSAIYYCARAYYGNLYYAMDYWGQGTSVTVSS (SEQ ID NO: 218) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATGCACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCA Anti-Fn14 antibody AbP4A8 heavy chain variable domain CDR1
(SEQ ID NO: 119) Protein sequence:
DYGMH Anti-Fn14 antibody AbP4A8 heavy chain variable domain CDR2
(SEQ ID NO: 120) Protein sequence:
VISTYNGYTNYNQKFKG Anti-Fn14 antibody AbP4A8 heavy chain variable domain CDR3
(SEQ ID NO: 121) Protein sequence:
AYYGNLYYAMDY Anti-Fn14 antibody AbP4A8 light chain variable domain (P4A8VL)
(SEQ ID NO: 122) Protein sequence (CDR1: underlined; CDR2: italic; CDR3: bold):
DIVLTQSPASLAVSLGQRATISCRASKSVSTSSYSYMHWYQQKPGQPPKLLIKY*ASNLES*GVPARFS
GSGSGTDFILNIHPVEEEDAATYYCQHSRELPFTFGSGTKLEIK (SEQ ID NO: 222) DNA sequence:
GACATTGTGCTGACACAGTCTCCTGCTTCCTTAGCTGTATCTCTGGGGCAGAGGGCCACCATCTC
ATGCAGGGCCAGCAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAA Anti-Fn14 antibody AbP4A8 light chain variable domain CDR1
(SEQ ID NO: 123) Protein sequence:
RASKSVSTSSYSYMH Anti-Fn14 antibody AbP4A8 light chain variable domain CDR2
(SEQ ID NO: 124) Protein sequence:
SNLES Anti-Fn14 antibody AbP4A8 light chain variable domain CDR3
(SEQ ID NO: 125) Protein sequence:
QHSRELPFT APPENDIX-continued

AMINO ACID AND NUCLEIC ACID SEQUENCES

Anti-Fn14 antibody AbP3G5 heavy chain variable domain (P3G5VH)
(SEQ ID NO: 126) Protein sequence (CDR1: underlined; CDR2: italic; CDR3: bold):
QVQLQQSGPEVVRPGVSVKISCKGSGYTFTDYGIHWVKQSHAKSLEWIG*VISTYNGYTNYNQKFKG*
KATMTVDKSSSTAYMELARLTSEDSAIYYCARAYYGNLYYAMDYWGQGTSVTVSS (SEQ ID NO: 226) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATACACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCA Anti-Fn14 antibody AbP3G5 heavy chain variable domain CDR1
(SEQ ID NO: 127) Protein sequence:
DYGIH Anti-Fn14 antibody AbP3G5 heavy chain variable domain CDR2
(SEQ ID NO: 128) Protein sequence:
VISTYNGYTNYNQKFKG Anti-Fn14 antibody AbP3G5 heavy chain variable domain CDR3
(SEQ ID NO: 129) Protein sequence:
AYYGNLYYAMDY Anti-Fn14 antibody AbP3G5 light chain variable domain (P3G5VL)
(SEQ ID NO: 130) Protein sequence (CDR1: underlined; CDR2: italic; CDR3: bold):
DIVLTQSPASLAVSLGQRATISCRANKSVSTSSYSYMHWYQQKPGQPPKLLIKY*ASNLES*GVPARFS
GSGSGTDFILNIHPVEEEDAATYYCQHSRELPFTFGSGTKLEIK (SEQ ID NO: 230) DNA sequence:
GACATTGTGCTGACACAGTCTCCTGCTTCCTTAGCTGTATCTCTGGGGCAGAGGGCCACCATCTC
ATGCAGGGCCAACAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAA Anti-Fn14 antibody AbP3G5 light chain variable domain CDR1
(SEQ ID NO: 131) Protein sequence:
RANKSVSTSSYSYMH Anti-Fn14 antibody AbP3G5 light chain variable domain CDR2
(SEQ ID NO: 132) Protein sequence:
ASNLES Anti-Fn14 antibody AbP3G5 light chain variable domain CDR3
(SEQ ID NO: 133) Protein sequence:
QHSRELPFT Linker subunit (G4S)
(SEQ ID NO: 139) Protein sequence:
GGGGS Linker (G4S X3)
(SEQ ID NO: 140) Protein sequence:
GGGGSGGGGSGGGGS (SEQ ID NO: 240) DNA sequence:
GGTGGTGGTGGTTCTGGCGGCGGCGGCTCCGGTGGTGGTGGTTCC Anti-Fn14 scFvP4A8VHVL
(SEQ ID NO: 141) Protein sequence:
QVQLQQSGPEVVRPGVSVKISCKGSGYTFTDYGMHWVKQSHAKSLEWIG*VISTYNGYTNYNQKFK*
*G*KATMTVDKSSSTAYMELARLTSEDSAIYYCARAYYGNLYYAMDYWGQGTSVTVSSGGGGSGGG
GSGGGGSDIVLTQSPASLAVSLGQRATISCRASKSVSTSSYSYMHWYQQKPGQPPKLLIKY*ASNLES*
GVPARFSGSGSGTDFILNIHPVEEEDAATYYCQHSRELPFTFGSGTKLEIK (SEQ ID NO: 241) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATGCACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAGCAAAAGTGTCAGTACATCTAGCTATAGTTATAT APPENDIX-continued

AMINO ACID AND NUCLEIC ACID SEQUENCES

GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAA

Anti-Fn14 scFvP4A8VLVH
(SEQ ID NO: 142) Protein sequence:
DIVLTQSPASLAVSLGQRATISCRASKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGMHWVKQSHAKSLEWIG*VISTYNGYTNYNQKFKG*KATMTV
DKSSSTAYMELARLTSEDSAIYYCARAYYGNLYYAMDYWGQGTSVTVSS (SEQ ID NO: 242) DNA sequence:
GACATTGTGCTGACACAGTCTCCTGCTTCCTTAGCTGTATCTCTGGGGCAGAGGGCCACCATCTC
ATGCAGGGCCAGCAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATGCACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCA Anti-Fn14 scFvP3GSVHVL
(SEQ ID NO: 143) Protein sequence:
QVQLQQSGPEVVRPGVSVKISCKGSGYTFTDYGIHWVKQSHAKSLEWIG*VISTYNGYTNYNQKFKG*
KATMTVDKSSSTAYMELARLTSEDSAIYYCARAYYGNLYYAMDYWGQGTSVTVSSGGGGSGGGG
SGGGGSDIVLTQSPASLAVSLGQRATISCRANKSVSTSSYSYMHWYQQKPGQPPKLLIKY*ASNLES*G
VPARFSGSGSGTDFILNIHPVEEEDAATYYCQHSRELPFTFGSGTKLEIK (SEQ ID NO: 243) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATACACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAACAAAAGTGTCAGTACATCTAGCTATAGTTATAT
GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAA Anti-Fn14 scFvP3GSVLVH
(SEQ ID NO: 144) Protein sequence:
DIVLTQSPASLAVSLGQRATISCRANKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGIHWVKQSHAKSLEWIG*VISTYNGYTNYNQKFKG*KATMTVD
KSSSTAYMELARLTSEDSAIYYCARAYYGNLYYAMDYWGQGTSVTVSS (SEQ ID NO: 244) DNA sequence:
GACATTGTGCTGACACAGTCTCCTGCTTCCTTAGCTGTATCTCTGGGGCAGAGGGCCACCATCTC
ATGCAGGGCCAACAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATACACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCA Human TWEAK (without Met/ATG)
(SEQ ID NO: 134) Protein sequence:
AARRSQRRRGRRGEPGTALLVPLALGLGLALACLGLLLAVVSLGSRASLSAQEPAQEELVAEEDQD
PSELNPQTEESQDPAPFLNRLVRPRRSAPKGRKTRARRAIAAHYEVHPRPGQDGAQAGVDGTVSG
WEEARINSSSPLRYNRQIGEFIVTRAGLYYLYCQVHFDEGKAVYLKLDLLVDGVLALRCLEEFSATA
ASSLGPQLRLCQVSGLLALRPGSSLRIRTLPWAHLKAAPFLTYFGLFQVH (SEQ ID NO: 234) DNA sequence:
GCCGCCCGTCGGAGCCAGAGGCGGAGGGGGCGCCGGGGGGAGCCGGGCACCGCCCTGCTGGTCCC
GCTCGCGCTGGGCCTGGGCCTGGCGCTGGCCTGCCTCGGCCTCCTGCTGGCCGTGGTCAGTTTGGG

AMINO ACID AND NUCLEIC ACID SEQUENCES

GAGCCGGGCATCGCTGTCCGCCCAGGAGCCTGCCCAGGAGGAGCTGGTGGCAGAGGAGGACCAGG
ACCCGTCGGAACTGAATCCCCAGACAGAAGAAAGCCAGGATCCTGCGCCTTTCCTGAACCGACTA
GTTCGGCCTCGCAGAAGTGCACCTAAAGGCCGGAAAACACGGGCTCGAAGAGCGATCGCAGCCCA
TTATGAAGTTCATCCACGACCTGGACAGGACGGAGCGCAGGCAGGTGTGGACGGGACAGTGAGT
GGCTGGGAGGAAGCCAGAATCAACAGCTCCAGCCCTCTGCGCTACAACCGCCAGATCGGGGAGTT
TATAGTCACCCGGGCTGGGCTCTACTACCTGTACTGTCAGGTGCACTTTGATGAGGGGAAGGCTG
TCTACCTGAAGCTGGACTTGCTGGTGGATGGTGTGCTGGCCCTGCGCTGCCTGGAGGAATTCTCA
GCCACTGCGGCCAGTTCCCTCGGGCCCCAGCTCCGCCTCTGCCAGGTGTCTGGGCTGTTGGCCCTG
CGGCCAGGGTCCTCCCTGCGGATCCGCACCCTCCCCTGGGCCCATCTCAAGGCTGCCCCCTTCCTC
ACCTACTTCGGACTCTTCCAGGTTCACTGA

Mouse TWEAK (without Met/ATG)
(SEQ ID NO: 135) Protein sequence:
AARRSQRRRGRRGEPGTALLAPLVLSLGLALACLGLLLVVVSLGSWATLSAQEPSQEELTAEDRRE
PPELNPQTEESQDVVPFLEQLVRPRRSAPKGRKARPRRAIAAHYEVHPRPGQDGAQAGVDGTVSG
WEETKINSSSPLRYDRQIGEFTVIRAGLYYLYCQVHFDEGKAVYLKLDLLVNGVLALRCLEEFSATA
ASSPGPQLRLCQVSGLLPLRPGSSLRIRTLPWAHLKAAPFLTYFGLFQVH (SEQ ID NO: 235) DNA sequence:
GCCGCCCGTCGGAGCCAGAGGCGGAGGGGGCGCCGGGGGGAGCCGGGCACCGCCCTGCTGGCCCC
GCTGGTGCTGAGCCTGGGCCTGGCGCTGGCCTGCCTTGGCCTCCTGCTGGTCGTGGTCAGCCTGG
GGAGCTGGGCAACGCTGTCTGCCCAGGAGCCTTCTCAGGAGGAGCTGACAGCAGAGGACCGCCGG
GAGCCCCCTGAACTGAATCCCCAGACAGAGGAAAGCCAGGATGTGGTACCTTTCTTGGAACAACT
AGTCCGGCCTCGAAGAAGTGCTCCTAAAGGCCGGAAGGCGCGGCCTCGCCGAGCTATTGCAGCCC
ATTATGAGGTTCATCCTCGGCCAGGACAGGATGGAGCACAAGCAGGTGTGGATGGGACAGTGAG
TGGCTGGGAAGAGACCAAAATCAACAGCTCCAGCCCTCTGCGCTACGACCGCCAGATTGGGGAAT
TTACAGTCATCAGGGCTGGGCTCTACTACCTGTACTGTCAGGTGCACTTTGATGAGGGAAAGGCT
GTCTACCTGAAGCTGGACTTGCTGGTGAACGGTGTGCTGGCCCTGCGCTGCCTGGAAGAATTCTC
AGCCACAGCAGCAAGCTCTCCTGGGCCCCAGCTCCGTTTGTGCCAGGTGTCTGGGCTGTTGCCGC
TGCGGCCAGGGTCTTCCCTTCGGATCCGCACCCTCCCCTGGGCTCATCTTAAGGCTGCCCCCTTCC
TAACCTACTTTGGACTCTTTCAAGTTCACTGA Human CD28 hinge (CD28H)
(SEQ ID NO: 145) Protein sequence:
VKGKHLCPSPLFPGPSKP (SEQ ID NO: 245) DNA sequence:
GTGAAAGGGAAACACCTTTGTCCAAGTCCCCTATTTCCCGGACCTTCTAAGCCC Human CD28 transmembrane domain (CD28TM)
(SEQ ID NO: 146) Protein sequence:
FWVLVVVGGVLACYSLLVTVAFIIFWV (SEQ ID NO: 246) DNA sequence:
TTTTGGGTGCTGGTGGTGGTTGGTGGAGTCCTGGCTTGCTATAGCTTGCTAGTAACAGTGGCCTT
TATTATTTTCTGGGTG Human CD3 zeta intracellular signaling domain (CD3zICS)
(SEQ ID NO: 147) Protein sequence:
LRVKFSRSADAPAYQQGQNQLYNELNLGRREEYDVLDKRRGRDPEMGGKPQRRKNPQEGLYNEL
QKDKMAEAYSEIGMKGERRRGKGHDGLYQGLSTATKDTYDALHMQALPPR (SEQ ID NO: 247) DNA sequence:
CTTAGAGTGAAGTTCAGCAGGAGCGCAGACGCCCCCGCGTACCAGCAGGGCCAGAACCAGCTCTA
TAACGAGCTCAATCTAGGACGAAGAGAGGAGTACGATGTTTTGGACAAGAGACGTGGCCGGGAC
CCTGAGATGGGGGGAAAGCCGCAGAGAAGGAAGAACCCTCAGGAAGGCCTGTACAATGAACTGC
AGAAAGATAAGATGGCGGAGGCCTACAGTGAGATTGGGATGAAAGGCGAGCGCCGGAGGGGCAA
GGGGCACGATGGCCTTTACCAGGGTCTCAGTACAGCCACCAAGGACACCTACGACGCCCTTCACA
TGCAGGCCCTGCCCCCTCGC T2A ribosomal skip sequence (T2A)
(SEQ ID NO: 150) Protein sequence:
ARAKRSGSGEGRGSLLTCGDVEENPGP (SEQ ID NO: 250) DNA sequence:
GCCAGGGCCAAAAGGTCTGGCTCCGGTGAGGGCAGAGGAAGTCTTCTAACATGCGGTGACGTGG
AGGAGAATCCCGGCCCT Human truncated CD19 (trCD19)
(SEQ ID NO: 151) Protein sequence:
MPPPRLLFFLLFLTPMEVRPEEPLVVKVEEGDNAVLQCLKGTSDGPTQQLTWSRESPLKPFLKLSL
GLPGLGIHMRPLAIWLFIFNVSQQMGGFYLCQPGPPSEKAWQPGWTVNVEGSGELFRWNVSDLG
GLGCGLKNRSSEGPSSPSGKLMSPKLYVWAKDRPEIWEGEPPCLPPRDSLNQSLSQDLTMAPGST
LWLSCGVPPDSVSRGPLSWTHVHPKGPKSLLSLELKDDRPARDMWVMETGLLLPRATAQDAGK
YYCHRGNLTMSFHLEITARPVLWHWLLRTGGWKVSAVTLAYLIFCLCSLVGILHLQRALVLR
RKRKRMT APPENDIX-continued

AMINO ACID AND NUCLEIC ACID SEQUENCES (SEQ ID NO: 251) DNA sequence:
ATGCCACCTCCTCGCCTCCTCTTCTTCCTCCTCTTCCTCACCCCCATGGAAGTCAGGCCCGAGGAA
CCTCTAGTGGTGAAGGTGGAAGAGGGAGATAACGCTGTGCTGCAGTGCCTCAAGGGGACCTCAG
ATGGCCCCACTCAGCAGCTGACCTGGTCTCGGGAGTCCCCGCTTAAACCCTTCTTAAAACTCAGC
CTGGGGCTGCCAGGCCTGGGAATCCACATGAGGCCCCTGGCCATCTGGCTTTTCATCTTCAACGT
CTCTCAACAGATGGGGGGCTTCTACCTGTGCCAGCCGGGGCCCCCCTCTGAGAAGGCCTGGCAGC
CTGGCTGGACAGTCAATGTGGAGGGCAGCGGGGAGCTGTTCCGGTGGAATGTTTCGGACCTAGGT
GGCCTGGGCTGTGGCCTGAAGAACAGGTCCTCAGAGGGCCCCAGCTCCCCTTCCGGGAAGCTCAT
GAGCCCCAAGCTGTATGTGTGGGCCAAAGACCGCCCTGAGATCTGGGAGGGAGAGCCTCCGTGTC
TCCCACCGAGGGACAGCCTGAACCAGAGCCTCAGCCAGGACCTCACCATGGCCCCTGGCTCCACAC
TCTGGCTGTCCTGTGGGGTACCCCCTGACTCTGTGTCCAGGGGCCCCCTCTCCTGGACCCATGTGC
ACCCCAAGGGGCCTAAGTCATTGCTGAGCCTAGAGCTGAAGGACGATCGCCCGGCCAGAGATATG
TGGGTAATGGAGACGGGTCTGTTGTTGCCCCGGGCCACAGCTCAAGACGCTGGAAAGTATTATTG
TCACCGTGGCAACCTGACCATGTCATTCCACCTGGAGATCACTGCTCGGCCAGTACTATGGCACT
GGCTGCTGAGGACTGGTGGCTGGAAGGTCTCAGCTGTGACTTTGGCTTATCTGATCTTCTGCCTG
TGTTCCCTTGTGGGCATTCTTCATCTTCAAAGAGCCCTGGTCCTGAGG
AGGAAAAGAAAGCGAATGACTTAA Human CD27 costimulatory domain (CD27CS)
(SEQ ID NO: 155) Protein sequence:
QRRKYRSNKGESPVEPAEPCRYSCPREEEGSTIPIQEDYRKPEPACSP (SEQ ID NO: 255) DNA sequence:
AGGAGTAAGAGGAGCCTCGAGCAACGAAGGAAATATAGATCAAACAAAGGAGAAAGTCCTGTGG
AGCCTGCAGAGCCTTGTCGTTACAGCTGCCCCAGGGAGGAGGAGGGCAGCACCATCCCCATCCAG
GAGGATTACCGAAAACCGGAGCCTGCCTGCTCCCCCAAG Human CD28 costimulatory domain (CD28CS)
(SEQ ID NO: 156) Protein sequence:
SKRSRLLHSDYMNMTPRRPGPTRKHYQPYAPPRDFAAYRS (SEQ ID NO: 256) DNA sequence:
AGGAGTAAGAGGAGCAGGCTCCTGCACAGTGACTACATGAACATGACTCCCCGCCGCCCCGGGCC
CACCCGCAAGCATTACCAGCCCTATGCCCCACCACGCGACTTCGCAGCCTATCGCTCC 4-1BB costimulatory domain (41BBCS)
(SEQ ID NO: 157) Protein sequence:
KRGRKKLLYIFKQPFMRPVQTTQEEDGCSCRFPEEEEGGCEL (SEQ ID NO: 257) DNA sequence:
AAACGGGGCAGAAAGAAACTCCTGTATATATTCAAACAACCATTTATGAGACCAGTACAAACTA
CTCAAGAGGAAGATGGCTGTAGCTGCCGATTTCCAGAAGAAGAAGAAGGAGGATGTGAACTG DAP10 costimulatory domain (DAP10CS)
(SEQ ID NO: 158) Protein sequence:
LCARPRRSPAQEDGKVYINMPGRG (SEQ ID NO: 258) DNA sequence:
CTGTGCGCACGCCCACGCCGCAGCCCCGCCCAAGAAGATGGCAAAGTCTACATCAACATGCCAG
GCAGGGGC Full CAR sequences, suitable for use in humans Nb MMRm22.84-CD28H- CD28TM-CD28CS-CD3zICS
(SEQ ID NO: 160) Protein sequence:
QVQLQESGGGLVQPGGSLRLSCAASGRTFSNYVNYAMGWFRQFPGKEREFVA*SISWSSVTT*YYADS
VKGRFTISRDNAKNTVYLQMNSLKPEDTAVYYCAAHLAQYSDYAYRDPHQFGAWGQGTQVTVS
SVKGKHLCPSPLFPGPSKPFWVLVVVGGVLACYSLLVTVAFIIFWVSKRSRLLHSDYMNMTPRRPG
PTRKHYQPYAPPRDFAAYRSLRVKFSRSADAPAYQQGQNQLYNELNLGRREEYDVLDKRRGRDP
EMGGKPQRRKNPQEGLYNELQKDKMAEAYSEIGMKGERRRGKGHDGLYQGLSTATKDTYDALH
MQALPPR (SEQ ID NO: 260) DNA sequence:
CAGGTTCAGCTGCAAGAGTCTGGCGGAGGACTGGTTCAACCTGGCGGAAGCCTGAGACTGTCTTG
TGCCGCTTCTGGCAGAACCTTCAGCAACTACGTGAACTACGCCATGGGCTGGTTCAGACAGTTCC
CCGGCAAAGAGAGAGAGTTCGTCGCCAGCATCAGCTGGTCTAGCGTGACCACCTACTACGCCGAC
AGCGTGAAGGGCAGATTCACCATCAGCAGAGACAACGCCAAGAACACCGTGTACCTGCAGATGA
ACAGCCTGAAGCCAGAGGACACCGCCGTGTACTACTGTGCTGCTCACCTGGCTCAGTACAGCGAC
TACGCCTACAGAGATCCCCACCAGTTTGGCGCTTGGGGCCAGGGAACACAAGTGACCGTTAGCTC
TGTGAAAGGGAAACACCTTTGTCCAAGTCCCCTATTTCCCGGACCTTCTAAGCCCTTTTGGGTGC
TGGTGGTGGTTGGTGGAGTCCTGGCTTGCTATAGCTTGCTAGTAACAGTGGCCTTTATTATTTTC
TGGGTGAGGAGTAAGAGGAGCAGGCTCCTGCACAGTGACTACATGAACATGACTCCCCGCCGCCC
CGGGCCCACCCGCAAGCATTACCAGCCCTATGCCCCACCACGCGACTTCGCAGCCTATCGCTCCCT
TAGAGTGAAGTTCAGCAGGAGCGCAGACGCCCCCGCGTACCAGCAGGGCCAGAACCAGCTCTATA
ACGAGCTCAATCTAGGACGAAGAGAGGAGTACGATGTTTTGGACAAGAGACGTGGCCGGGACCC
TGAGATGGGGGGAAAGCCGCAGAGAAGGAAGAACCCTCAGGAAGGCCTGTACAATGAACTGCAG
AAAGATAAGATGGCGGAGGCCTACAGTGAGATTGGGATGAAAGGCGAGCGCCGGAGGGGCAAGG APPENDIX-continued

AMINO ACID AND NUCLEIC ACID SEQUENCES

GGCACGATGGCCTTTACCAGGGTCTCAGTACAGCCACCAAGGACACCTACGACGCCCTTCACATG
CAGGCCCTGCCCCCTCGC

NbMMRm5.38-CD28H-CD28TM-CD28CS-CD3zICS
(SEQ ID NO: 161) Protein sequence:
QVQLQESGGGLVQAGGSLRLSCAASGFTDDDYDIGWFRQAPGKEREGVS*CISSSDGST*YYADSVKG
RFTISSDNAKNTVYLQMNSLKPEDTAVYYCAADFFRWDSGSYYVRGCRHATYDYWGQGTQVTV
SSVKGKHLCPSPLFPGPSKPFWVLVVVGGVLACYSLLVTVAFIIFWVSKRSRLLHSDYMNMTPRRP
GPTRKHYQPYAPPRDFAAYRSLRVKFSRSADAPAYQQGQNQLYNELNLGRREEYDVLDKRRGRD
PEMGGKPQRRKNPQEGLYNELQKDKMAEAYSEIGMKGERRRGKGHDGLYQGLSTATKDTYDAL
HMQALPPR (SEQ ID NO: 261) DNA sequence:
CAGGTTCAGCTGCAAGAGTCTGGCGGAGGACTGGTTCAAGCTGGCGGAAGCCTGAGACTGTCTTG
TGCCGCTTCTGGCTTCACCGACGACGACTACGATATCGGCTGGTTCAGACAGGCCCCTGGCAAAG
AGAGAGAGGGCGTCAGCTGTATCAGCAGCTCTGACGGCTCTACCTACTACGCCGACAGCGTGAAG
GGCAGATTCACCATCAGCAGCGACAACGCCAAGAACACCGTGTACCTGCAGATGAACTCTCTGAA
GCCCGAGGACACCGCCGTGTACTACTGTGCCGCCGACTTCTTCAGATGGGACAGCGGCAGCTACT
ACGTGCGGGGATGTAGACACGCCACCTACGATTACTGGGGCCAGGGCACACAAGTGACCGTGTCA
TCTGTGAAAGGGAAACACCTTTGTCCAAGTCCCCTATTTCCCGGACCTTCTAAGCCCTTTTGGGT
GCTGGTGGTGGTTGGTGGAGTCCTGGCTTGCTATAGCTTGCTAGTAACAGTGGCCTTTATTATTT
TCTGGGTGAGGAGTAAGAGGAGCAGGCTCCTGCACAGTGACTACATGAACATGACTCCCCGCCGC
CCCGGGCCCACCCGCAAGCATTACCAGCCCTATGCCCCACCACGCGACTTCGCAGCCTATCGCTCC
CTTAGAGTGAAGTTCAGCAGGAGCGCAGACGCCCCCGCGTACCAGCAGGGCCAGAACCAGCTCTA
TAACGAGCTCAATCTAGGACGAAGAGAGGAGTACGATGTTTTGGACAAGAGACGTGGCCGGGAC
CCTGAGATGGGGGGAAAGCCGCAGAGAAGGAAGAACCCTCAGGAAGGCCTGTACAATGAACTGC
AGAAAGATAAGATGGCGGAGGCCTACAGTGAGATTGGGATGAAAGGCGAGCGCCGGAGGGGCAA
GGGGCACGATGGCCTTTACCAGGGTCTCAGTACAGCCACCAAGGACACCTACGACGCCCTTCACA
TGCAGGCCCTGCCCCCTCGC scFvP4A8VHVL-CD28H-CD28TM-CD28CS-CD3zICS
(SEQ ID NO: 162) Protein sequence:
QVQLQQSGPEVVRPGVSVKISCKGSGYTFTDYGMHWVKQSHAKSLEWIG*VISTYNGYTNYNQKFK
G*KATMTVDKSSSTAYMELARLTSEDSAIYYCARAYYGNLYYAMDYWGQGTSVTVSSGGGGSGGG
GSGGGGSDIVLTQSPASLAVSLGQRATISCRASKSVSTSSYSYMHWYQQKPGQPPKLLIKY*ASNLES*
GVPARFSGSGSGTDFILNIHPVEEEDAATYYCQHSRELPFTFGSGTKLEIKVKGKHLCPSPLFPGPS
KPFWVLVVVGGVLACYSLLVTVAFIIFWVSKRSRLLHSDYMNMTPRRPGPTRKHYQPYAPPRDFA
AYRSLRVKFSRSADAPAYQQGQNQLYNELNLGRREEYDVLDKRRGRDPEMGGKPQRRKNPQEGL
YNELQKDKMAEAYSEIGMKGERRRGKGHDGLYQGLSTATKDTYDALHMQALPPR (SEQ ID NO: 262) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATGCACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAGCAAAAGTGTCAGTACATCTAGCTATAGTTATAT
GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGAGGAGTAAGAGGAGCAGGCTCCTGCACAGT
GACTACATGAACATGACTCCCCGCCGCCCCGGGCCCACCCGCAAGCATTACCAGCCCTATGCCCCA
CCACGCGACTTCGCAGCCTATCGCTCCCTTAGAGTGAAGTTCAGCAGGAGCGCAGACGCCCCCGC
GTACCAGCAGGGCCAGAACCAGCTCTATAACGAGCTCAATCTAGGACGAAGAGAGGAGTACGAT
GTTTTGGACAAGAGACGTGGCCGGGACCCTGAGATGGGGGGAAAGCCGCAGAGAAGGAAGAACC
CTCAGGAAGGCCTGTACAATGAACTGCAGAAAGATAAGATGGCGGAGGCCTACAGTGAGATTGG
GATGAAAGGCGAGCGCCGGAGGGGCAAGGGGCACGATGGCCTTTACCAGGGTCTCAGTACAGCCA
CCAAGGACACCTACGACGCCCTTCACATGCAGGCCCTGCCCCCTCGC scFvP4A8VLVH-CD28H-CD28TM-CD28CS-CD3zICS
(SEQ ID NO: 163) Protein sequence:
DIVLTQSPASLAVSLGQRATISCRASKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGMHWVKQSHAKSLEWIG*VISTYNGYTNYNQKFKG*KATMTV
DKSSSTAYMELARLTSEDSAIYYCARAYYGNLYYAMDYWGQGTSVTVSSVKGKHLCPSPLFPGPS
KPFWVLVVVGGVLACYSLLVTVAFIIFWVSKRSRLLHSDYMNMTPRRPGPTRKHYQPYAPPRDFA
AYRSLRVKFSRSADAPAYQQGQNQLYNELNLGRREEYDVLDKRRGRDPEMGGKPQRRKNPQEGL
YNELQKDKMAEAYSEIGMKGERRRGKGHDGLYQGLSTATKDTYDALHMQALPPR (SEQ ID NO: 263) DNA sequence:
GACATTGTGCTGACACAGTCTCCTGCTTCCTTAGCTGTATCTCTGGGGCAGAGGGCCACCATCTC
ATGCAGGGCCAGCAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG APPENDIX-continued

AMINO ACID AND NUCLEIC ACID SEQUENCES

CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATGCACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGAGGAGTAAGAGGAGCAGGCTCCTGCACAGT
GACTACATGAACATGACTCCCCGCCGCCCCGGGCCCACCCGCAAGCATTACCAGCCCTATGCCCCA
CCACGCGACTTCGCAGCCTATCGCTCCCTTAGAGTGAAGTTCAGCAGGAGCGCAGACGCCCCCGC
GTACCAGCAGGGCCAGAACCAGCTCTATAACGAGCTCAATCTAGGACGAAGAGAGGAGTACGAT
GTTTTGGACAAGAGACGTGGCCGGGACCCTGAGATGGGGGGAAAGCCGCAGAGAAGGAAGAACC
CTCAGGAAGGCCTGTACAATGAACTGCAGAAAGATAAGATGGCGGAGGCCTACAGTGAGATTGG
GATGAAAGGCGAGCGCCGGAGGGGCAAGGGGCACGATGGCCTTTACCAGGGTCTCAGTACAGCCA
CCAAGGACACCTACGACGCCCTTCACATGCAGGCCCTGCCCCCTCGC scFvP3G5VHVL-CD28H-CD28TM-CD28CS-CD3zICS
(SEQ ID NO: 164) Protein sequence:
QVQLQQSGPEVVRPGVSVKISCKGSGYTFTDYGIHWVKQSHAKSLEWIG*VISTYNGYTNYNQKFKG*
KATMTVDKSSSTAYMELARLTSEDSAIYYCARAYYGNLYYAMDYWGQGTSVTVSSGGGGSGGGG
SGGGGSDIVLTQSPASLAVSLGQRATISCRANKSVSTSSYSYMHWYQQKPGQPPKLLIKY*ASNLES*G
VPARFSGSGSGTDFILNIHPVEEEDAATYYCQHSRELPFTFGSGTKLEIKVKGKHLCPSPLFPGPSK
PFWVLVVVGGVLACYSLLVTVAFIIFWVSKRSRLLHSDYMNMTPRRPGPTRKHYQPYAPPRDFAA
YRSLRVKFSRSADAPAYQQGQNQLYNELNLGRREEYDVLDKRRGRDPEMGGKPQRRKNPQEGLY
NELQKDKMAEAYSEIGMKGERRRGKGHDGLYQGLSTATKDTYDALHMQALPPR (SEQ ID NO: 264) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATACACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAACAAAAGTGTCAGTACATCTAGCTATAGTTATAT
GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGAGGAGTAAGAGGAGCAGGCTCCTGCACAGT
GACTACATGAACATGACTCCCCGCCGCCCCGGGCCCACCCGCAAGCATTACCAGCCCTATGCCCCA
CCACGCGACTTCGCAGCCTATCGCTCCCTTAGAGTGAAGTTCAGCAGGAGCGCAGACGCCCCCGC
GTACCAGCAGGGCCAGAACCAGCTCTATAACGAGCTCAATCTAGGACGAAGAGAGGAGTACGAT
GTTTTGGACAAGAGACGTGGCCGGGACCCTGAGATGGGGGGAAAGCCGCAGAGAAGGAAGAACC
CTCAGGAAGGCCTGTACAATGAACTGCAGAAAGATAAGATGGCGGAGGCCTACAGTGAGATTGG
GATGAAAGGCGAGCGCCGGAGGGGCAAGGGGCACGATGGCCTTTACCAGGGTCTCAGTACAGCCA
CCAAGGACACCTACGACGCCCTTCACATGCAGGCCCTGCCCCCTCGC scFvP3G5VLVH-CD28H-CD28TM-CD28CS-CD3zICS
(SEQ ID NO: 165) Protein sequence:
DIVLTQSPASLAVSLGQRATISCRANKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGIHWVKQSHAKSLEWIG*VISTYNGYTNYNQKFKG*KATMTVD
KSSSTAYMELARLTSEDSAIYYCARAYYGNLYYAMDYWGQGTSVTVSSVKGKHLCPSPLFPGPSK
PFWVLVVVGGVLACYSLLVTVAFIIFWVSKRSRLLHSDYMNMTPRRPGPTRKHYQPYAPPRDFAA
YRSLRVKFSRSADAPAYQQGQNQLYNELNLGRREEYDVLDKRRGRDPEMGGKPQRRKNPQEGLY
NELQKDKMAEAYSEIGMKGERRRGKGHDGLYQGLSTATKDTYDALHMQALPPR (SEQ ID NO: 265) DNA sequence:
GACATTGTGCTGACACAGTCTCCTGCTTCCTTAGCTGTATCTCTGGGGCAGAGGGCCACCATCTC
ATGCAGGGCCAACAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATACACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGAGGAGTAAGAGGAGCAGGCTCCTGCACAGT
GACTACATGAACATGACTCCCCGCCGCCCCGGGCCCACCCGCAAGCATTACCAGCCCTATGCCCCA
CCACGCGACTTCGCAGCCTATCGCTCCCTTAGAGTGAAGTTCAGCAGGAGCGCAGACGCCCCCGC APPENDIX-continued

AMINO ACID AND NUCLEIC ACID SEQUENCES

GTACCAGCAGGGCCAGAACCAGCTCTATAACGAGCTCAATCTAGGACGAAGAGAGGAGTACGAT
GTTTTGGACAAGAGACGTGGCCGGGACCCTGAGATGGGGGGAAAGCCGCAGAGAAGGAAGAACC
CTCAGGAAGGCCTGTACAATGAACTGCAGAAAGATAAGATGGCGGAGGCCTACAGTGAGATTGG
GATGAAAGGCGAGCGCCGGAGGGGCAAGGGGCACGATGGCCTTTACCAGGGTCTCAGTACAGCCA
CCAAGGACACCTACGACGCCCTTCACATGCAGGCCCTGCCCCCTCGC

CD3zICS-CD28CS-TWEAK
(SEQ ID NO: 136) Protein sequence:
LRVKFSRSADAPAYQQGQNQLYNELNLGRREEYDVLDKRRGRDPEMGGKPQRRKNPQEGLYNEL
QKDKMAEAYSEIGMKGERRRGKGHDGLYQGLSTATKDTYDALHMQALPPRSKRSRLLHSDYMN
MTPRRPGPTRKHYQPYAPPRDFAAYRSAARRSQRRRGRRGEPGTALLVPLALGLGLALACLGLLL
AVVSLGSRASLSAQEPAQEELVAEEDQDPSELNPQTEESQDPAPFLNRLVRPRRSAPKGRKTRAR
RAIAAHYEVHPRPGQDGAQAGVDGTVSGWEEARINSSSPLRYNRQIGEFIVTRAGLYYLYCQVHFD
EGKAVYLKLDLLVDGVLALRCLEEFSATAASSLGPQLRLCQVSGLLALRPGSSLRIRTLPWAHLKA
APFLTYFGLFQVH (SEQ ID NO: 236) DNA sequence:
CTTAGAGTGAAGTTCAGCAGGAGCGCAGACGCCCCCGCGTACCAGCAGGGCCAGAACCAGCTCTA
TAACGAGCTCAATCTAGGACGAAGAGAGGAGTACGATGTTTTGGACAAGAGACGTGGCCGGGAC
CCTGAGATGGGGGGAAAGCCGCAGAGAAGGAAGAACCCTCAGGAAGGCCTGTACAATGAACTGC
AGAAAGATAAGATGGCGGAGGCCTACAGTGAGATTGGGATGAAAGGCGAGCGCCGGAGGGGCAA
GGGGCACGATGGCCTTTACCAGGGTCTCAGTACAGCCACCAAGGACACCTACGACGCCCTTCACA
TGCAGGCCCTGCCCCCTCGCAGGAGTAAGAGGAGCAGGCTCCTGCACAGTGACTACATGAACATG
ACTCCCCGCCGCCCCGGGCCCACCCGCAAGCATTACCAGCCCTATGCCCCACCACGCGACTTCGCA
GCCTATCGCTCCGCCGCCCGTCGGAGCCAGAGGCGGAGGGGGCGCCGGGGGGAGCCGGGCACCGC
CCTGCTGGTCCCGCTCGCGCTGGGCCTGGGCCTGGCGCTGGCCTGCCTCGGCCTCCTGCTGGCCGT
GGTCAGTTTGGGGAGCCGGGCATCGCTGTCCGCCCAGGAGCCTGCCCAGGAGGAGCTGGTGGCAG
AGGAGGACCAGGACCCGTCGGAACTGAATCCCCAGACAGAAGAAAGCCAGGATCCTGCGCCTTTC
CTGAACCGACTAGTTCGGCCTCGCAGAAGTGCACCTAAAGGCCGGAAAACACGGGCTCGAAGAGC
GATCGCAGCCCATTATGAAGTTCATCCACGACCTGGACAGGACGGAGCGCAGGCAGGTGTGGACG
GGACAGTGAGTGGCTGGGAGGAAGCCAGAATCAACAGCTCCAGCCCTCTGCGCTACAACCGCCAG
ATCGGGGAGTTTATAGTCACCCGGGCTGGGCTCTACTACCTGTACTGTCAGGTGCACTTTGATGA
GGGGAAGGCTGTCTACCTGAAGCTGGACTTGCTGGTGGATGGTGTGCTGGCCCTGCGCTGCCTGG
AGGAATTCTCAGCCACTGCGGCCAGTTCCCTCGGGCCCCAGCTCCGCCTCTGCCAGGTGTCTGGGC
TGTTGGCCCTGCGGCCAGGGTCCTCCCTGCGGATCCGCACCCTCCCCTGGGCCCATCTCAAGGCTG
CCCCCTTCCTCACCTACTTCGGACTCTTCCAGGTTCACTGA NbMMRm22.84-CD28H-CD28TM-41BBCS-CD3zICS
(SEQ ID NO: 166) Protein sequence:
QVQLQESGGGLVQPGGSLRLSCAASGRTFSNYVNYAMGWFRQFPGKEREFVA*SISWSSVTT*YYADS
VKGRFTISRDNAKNTVYLQMNSLKPEDTAVYYCAAHLAQYSDYAYRDPHQFGAWGQGTQVTVS
SVKGKHLCPSPLFPGPSKPFWVLVVVGGVLACYSLLVTVAFIIFWVKRGRKKLLYIFKQPFMRPVQ
TTQEEDGCSCRFPEEEEGGCELLRVKFSRSADAPAYQQGQNQLYNELNLGRREEYDVLDKRRGRD
PEMGGKPQRRKNPQEGLYNELQKDKMAEAYSEIGMKGERRRGKGHDGLYQGLSTATKDTYDAL
HMQALPPR (SEQ ID NO: 266) DNA sequence:
CAGGTTCAGCTGCAAGAGTCTGGCGGAGGACTGGTTCAACCTGGCGGAAGCCTGAGACTGTCTTG
TGCCGCTTCTGGCAGAACCTTCAGCAACTACGTGAACTACGCCATGGGCTGGTTCAGACAGTTCC
CCGGCAAAGAGAGAGAGTTCGTCGCCAGCATCAGCTGGTCTAGCGTGACCACCTACTACGCCGAC
AGCGTGAAGGGCAGATTCACCATCAGCAGAGACAACGCCAAGAACACCGTGTACCTGCAGATGA
ACAGCCTGAAGCCAGAGGACACCGCCGTGTACTACTGTGCTGCTCACCTGGCTCAGTACAGCGAC
TACGCCTACAGAGATCCCCACCAGTTTGGCGCTTGGGGCCAGGGAACACAAGTGACCGTTAGCTC
TGTGAAAGGGAAACACCTTTGTCCAAGTCCCCTATTTCCCGGACCTTCTAAGCCCTTTTGGGTGC
TGGTGGTGGTTGGTGGAGTCCTGGCTTGCTATAGCTTGCTAGTAACAGTGGCCTTTATTATTTTC
TGGGTGAAACGGGGCAGAAAGAAACTCCTGTATATATTCAAACAACCATTTATGAGACCAGTAC
AAACTACTCAAGAGGAAGATGGCTGTAGCTGCCGATTTCCAGAAGAAGAAGAAGGAGGATGTGA
ACTGCTTAGAGTGAAGTTCAGCAGGAGCGCAGACGCCCCCGCGTACCAGCAGGGCCAGAACCAGC
TCTATAACGAGCTCAATCTAGGACGAAGAGAGGAGTACGATGTTTTGGACAAGAGACGTGGCCG
GGACCCTGAGATGGGGGGAAAGCCGCAGAGAAGGAAGAACCCTCAGGAAGGCCTGTACAATGAA
CTGCAGAAAGATAAGATGGCGGAGGCCTACAGTGAGATTGGGATGAAAGGCGAGCGCCGGAGGG
GCAAGGGGCACGATGGCCTTTACCAGGGTCTCAGTACAGCCACCAAGGACACCTACGACGCCCTT
CACATGCAGGCCCTGCCCCCTCGC NbMMRm5.38-CD28H-CD28TM-41BBCS-CD3zICS
(SEQ ID NO: 167) Protein sequence:
QVQLQESGGGLVQAGGSLRLSCAASGFTDDDYDIGWFRQAPGKEREGVS*CISSSDGST*YYADSVKG
RFTISSDNAKNTVYLQMNSLKPEDTAVYYCAADFFRWDSGSYYVRGCRHATYDYWGQGTQVTV
SSVKGKHLCPSPLFPGPSKPFWVLVVVGGVLACYSLLVTVAFIIFWVKRGRKKLLYIFKQPFMRPV
QTTQEEDGCSCRFPEEEEGGCELLRVKFSRSADAPAYQQGQNQLYNELNLGRREEYDVLDKRRGR
DPEMGGKPQRRKNPQEGLYNELQKDKMAEAYSEIGMKGERRRGKGHDGLYQGLSTATKDTYDA
LHMQALPPR (SEQ ID NO: 267) DNA sequence:
CAGGTTCAGCTGCAAGAGTCTGGCGGAGGACTGGTTCAAGCTGGCGGAAGCCTGAGACTGTCTTG
TGCCGCTTCTGGCTTCACCGACGACGACTACGATATCGGCTGGTTCAGACAGGCCCCTGGCAAAG
AGAGAGAGGGCGTCAGCTGTATCAGCAGCTCTGACGGCTCTACCTACTACGCCGACAGCGTGAAG
GGCAGATTCACCATCAGCAGCGACAACGCCAAGAACACCGTGTACCTGCAGATGAACTCTCTGAA

AMINO ACID AND NUCLEIC ACID SEQUENCES

GCCCGAGGACACCGCCGTGTACTACTGTGCCGCCGACTTCTTCAGATGGGACAGCGGCAGCTACT
ACGTGCGGGGATGTAGACACGCCACCTACGATTACTGGGGCCAGGGCACACAAGTGACCGTGTCA
TCTGTGAAAGGGAAACACCTTTGTCCAAGTCCCCTATTTCCCGGACCTTCTAAGCCCTTTTGGGT
GCTGGTGGTGGTTGGTGGAGTCCTGGCTTGCTATAGCTTGCTAGTAACAGTGGCCTTTATTATTT
TCTGGGTGAAACGGGGCAGAAAGAAACTCCTGTATATATTCAAACAACCATTTATGAGACCAGT
ACAAACTACTCAAGAGGAAGATGGCTGTAGCTGCCGATTTCCAGAAGAAGAAGAAGGAGGATGT
GAACTGCTTAGAGTGAAGTTCAGCAGGAGCGCAGACGCCCCCGCGTACCAGCAGGGCCAGAACCA
GCTCTATAACGAGCTCAATCTAGGACGAAGAGAGGAGTACGATGTTTTGGACAAGAGACGTGGC
CGGGACCCTGAGATGGGGGGAAAGCCGCAGAGAAGGAAGAACCCTCAGGAAGGCCTGTACAATG
AACTGCAGAAAGATAAGATGGCGGAGGCCTACAGTGAGATTGGGATGAAAGGCGAGCGCCGGAG
GGGCAAGGGGCACGATGGCCTTTACCAGGGTCTCAGTACAGCCACCAAGGACACCTACGACGCCC
TTCACATGCAGGCCCTGCCCCCTCGC scFvP4A8VHVL-CD28H-CD28TM-41BBCS-CD3zICS
(SEQ ID NO: 168) Protein sequence:
QVQLQQSGPEVVRPGVSVKISCKGSGYTFTDYGMHWVKQSHAKSLEWIG*VISTYNGYTNYNQKFK*
*G*KATMTVDKSSSTAYMELARLTSEDSAIYYCARAYYGNLYYAMDYWGQGTSVTVSSGGGGSGGG
GSGGGGSDIVLTQSPASLAVSLGQRATISCRASKSVSTSSYSYMHWYQQKPGQPPKLLIKY*ASNLES*
GVPARFSGSGSGTDFILNIHPVEEEDAATYYCQHSRELPFTFGSGTKLEIKVKGKHLCPSPLFPGPS
KPFWVLVVVGGVLACYSLLVTVAFIIFWVKRGRKKLLYIFKQPFMRPVQTTQEEDGCSCRFPEEEE
GGCELLRVKFSRSADAPAYQQGQNQLYNELNLGRREEYDVLDKRRGRDPEMGGKPQRRKNPQEG
LYNELQKDKMAEAYSEIGMKGERRRGKGHDGLYQGLSTATKDTYDALHMQALPPR (SEQ ID NO: 268) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATGCACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAGCAAAAGTGTCAGTACATCTAGCTATAGTTATAT
GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGAAACGGGGCAGAAAGAAACTCCTGTATATA
TTCAAACAACCATTTATGAGACCAGTACAAACTACTCAAGAGGAAGATGGCTGTAGCTGCCGAT
TTCCAGAAGAAGAAGAAGGAGGATGTGAACTGCTTAGAGTGAAGTTCAGCAGGAGCGCAGACGC
CCCCGCGTACCAGCAGGGCCAGAACCAGCTCTATAACGAGCTCAATCTAGGACGAAGAGAGGAGT
ACGATGTTTTGGACAAGAGACGTGGCCGGGACCCTGAGATGGGGGGAAAGCCGCAGAGAAGGAA
GAACCCTCAGGAAGGCCTGTACAATGAACTGCAGAAAGATAAGATGGCGGAGGCCTACAGTGAG
ATTGGGATGAAAGGCGAGCGCCGGAGGGGCAAGGGGCACGATGGCCTTTACCAGGGTCTCAGTA
CAGCCACCAAGGACACCTACGACGCCCTTCACATGCAGGCCCTGCCCCCTCGC scFvP4A8VLVH-CD28H-CD28TM-41BBCS-CD3zICS
(SEQ ID NO: 169) Protein sequence:
DIVLTQSPASLAVSLGQRATISCRASKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGMHWVKQSHAKSLEWIG*VISTYNGYTNYNQKFKG*KATMTV
DKSSSTAYMELARLTSEDSAIYYCARAYYGNLYYAMDYWGQGTSVTVSSVKGKHLCPSPLFPGPS
KPFWVLVVVGGVLACYSLLVTVAFIIFWVKRGRKKLLYIFKQPFMRPVQTTQEEDGCSCRFPEEEE
GGCELLRVKFSRSADAPAYQQGQNQLYNELNLGRREEYDVLDKRRGRDPEMGGKPQRRKNPQEG
LYNELQKDKMAEAYSEIGMKGERRRGKGHDGLYQGLSTATKDTYDALHMQALPPR (SEQ ID NO: 269) DNA sequence:
GACATTGTGCTGACACAGTCTCCTGCTTCCTTAGCTGTATCTCTGGGGCAGAGGGCCACCATCTC
ATGCAGGGCCAGCAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATGCACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGAAACGGGGCAGAAAGAAACTCCTGTATATA
TTCAAACAACCATTTATGAGACCAGTACAAACTACTCAAGAGGAAGATGGCTGTAGCTGCCGAT
TTCCAGAAGAAGAAGAAGGAGGATGTGAACTGCTTAGAGTGAAGTTCAGCAGGAGCGCAGACGC
CCCCGCGTACCAGCAGGGCCAGAACCAGCTCTATAACGAGCTCAATCTAGGACGAAGAGAGGAGT
ACGATGTTTTGGACAAGAGACGTGGCCGGGACCCTGAGATGGGGGGAAAGCCGCAGAGAAGGAA
GAACCCTCAGGAAGGCCTGTACAATGAACTGCAGAAAGATAAGATGGCGGAGGCCTACAGTGAG
ATTGGGATGAAAGGCGAGCGCCGGAGGGGCAAGGGGCACGATGGCCTTTACCAGGGTCTCAGTA
CAGCCACCAAGGACACCTACGACGCCCTTCACATGCAGGCCCTGCCCCCTCGC APPENDIX-continued

AMINO ACID AND NUCLEIC ACID SEQUENCES scFvP3G5VHVL-CD28H-CD28TM-41BBCS-CD3zICS
(SEQ ID NO: 170) Protein sequence:
QVQLQQSGPEVVRPGVSVKISCKGSGYTFTDYGIHWVKQSHAKSLEWIG*VISTYNGYTNYNQKFKG*
KATMTVDKSSSTAYMELARLTSEDSAIYYCARAYYGNLYYAMDYWGQGTSVTVSSGGGGSGGGG
SGGGGSDIVLTQSPASLAVSLGQRATISCRANKSVSTSSYSYMHWYQQKPGQPPKLLIKY*ASNLES*G
VPARFSGSGSGTDFILNIHPVEEEDAATYYCQHSRELPFTFGSGTKLEIKVKGKHLCPSPLFPGPSK
PFWVLVVVGGVLACYSLLVTVAFIIFWVKRGRKKLLYIFKQPFMRPVQTTQEEDGCSCRFPEEEEG
GCELLRVKFSRSADAPAYQQGQNQLYNELNLGRREEYDVLDKRRGRDPEMGGKPQRRKNPQEGL
YNELQKDKMAEAYSEIGMKGERRRGKGHDGLYQGLSTATKDTYDALHMQALPPR (SEQ ID NO: 270) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATACACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAACAAAAGTGTCAGTACATCTAGCTATAGTTATAT
GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGAAACGGGGCAGAAAGAAACTCCTGTATATA
TTCAAACAACCATTTATGAGACCAGTACAAACTACTCAAGAGGAAGATGGCTGTAGCTGCCGAT
TTCCAGAAGAAGAAGAAGGAGGATGTGAACTGCTTAGAGTGAAGTTCAGCAGGAGCGCAGACGC
CCCCGCGTACCAGCAGGGCCAGAACCAGCTCTATAACGAGCTCAATCTAGGACGAAGAGAGGAGT
ACGATGTTTTGGACAAGAGACGTGGCCGGGACCCTGAGATGGGGGGAAAGCCGCAGAGAAGGAA
GAACCCTCAGGAAGGCCTGTACAATGAACTGCAGAAAGATAAGATGGCGGAGGCCTACAGTGAG
ATTGGGATGAAAGGCGAGCGCCGGAGGGGCAAGGGGCACGATGGCCTTTACCAGGGTCTCAGTA
CAGCCACCAAGGACACCTACGACGCCCTTCACATGCAGGCCCTGCCCCCTCGC scFvP3G5VLVH-CD28H-CD28TM-41BBCS-CD3zICS
(SEQ ID NO: 171) Protein sequence:
DIVLTQSPASLAVSLGQRATISCRANKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGIHWVKQSHAKSLEWIG*VISTYNGYTNYNQKFKG*KATMTVD
KSSSTAYMELARLTSEDSAIYYCARAYYGNLYYAMDYWGQGTSVTVSSVKGKHLCPSPLFPGPSK
PFWVLVVVGGVLACYSLLVTVAFIIFWVKRGRKKLLYIFKQPFMRPVQTTQEEDGCSCRFPEEEEG
GCELLRVKFSRSADAPAYQQGQNQLYNELNLGRREEYDVLDKRRGRDPEMGGKPQRRKNPQEGL
YNELQKDKMAEAYSEIGMKGERRRGKGHDGLYQGLSTATKDTYDALHMQALPPR (SEQ ID NO: 271) DNA sequence:
GACATTGTGCTGACACAGTCTCCTGCTTCCTTAGCTGTATCTCTGGGGCAGAGGGCCACCATCTC
ATGCAGGGCCAACAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATACACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGAAACGGGGCAGAAAGAAACTCCTGTATATA
TTCAAACAACCATTTATGAGACCAGTACAAACTACTCAAGAGGAAGATGGCTGTAGCTGCCGAT
TTCCAGAAGAAGAAGAAGGAGGATGTGAACTGCTTAGAGTGAAGTTCAGCAGGAGCGCAGACGC
CCCCGCGTACCAGCAGGGCCAGAACCAGCTCTATAACGAGCTCAATCTAGGACGAAGAGAGGAGT
ACGATGTTTTGGACAAGAGACGTGGCCGGGACCCTGAGATGGGGGGAAAGCCGCAGAGAAGGAA
GAACCCTCAGGAAGGCCTGTACAATGAACTGCAGAAAGATAAGATGGCGGAGGCCTACAGTGAG
ATTGGGATGAAAGGCGAGCGCCGGAGGGGCAAGGGGCACGATGGCCTTTACCAGGGTCTCAGTA
CAGCCACCAAGGACACCTACGACGCCCTTCACATGCAGGCCCTGCCCCCTCGC CD3zICS-41BBCS-TWEAK
(SEQ ID NO: 137) Protein sequence:
LRVKFSRSADAPAYQQGQNQLYNELNLGRREEYDVLDKRRGRDPEMGGKPQRRKNPQEGLYNEL
QKDKMAEAYSEIGMKGERRRGKGHDGLYQGLSTATKDTYDALHMQALPPRKRGRKKLLYIFKQP
FMRPVQTTQEEDGCSCRFPEEEEGGCELAARRSQRRRGRRGEPGTALLVPLALGLGLALACLGLLL
AVVSLGSRASLSAQEPAQEELVAEEDQDPSELNPQTEESQDPAPFLNRLVRPRRSAPKGRKTRAR
RAIAAHYEVHPRPGQDGAQAGVDGTVSGWEEARINSSSPLRYNRQIGEFIVTRAGLYYLYCQVHFD
EGKAVYLKLDLLVDGVLALRCLEEFSATAASSLGPQLRLCQVSGLLALRPGSSLRIRTLPWAHLKA
APFLTYFGLFQVH

AMINO ACID AND NUCLEIC ACID SEQUENCES (SEQ ID NO: 237) DNA sequence:
CTTAGAGTGAAGTTCAGCAGGAGCGCAGACGCCCCCGCGTACCAGCAGGGCCAGAACCAGCTCTA
TAACGAGCTCAATCTAGGACGAAGAGAGGAGTACGATGTTTTGGACAAGAGACGTGGCCGGGAC
CCTGAGATGGGGGGAAAGCCGCAGAGAAGGAAGAACCCTCAGGAAGGCCTGTACAATGAACTGC
AGAAAGATAAGATGGCGGAGGCCTACAGTGAGATTGGGATGAAAGGCGAGCAAACGGGGCAGAA
AGAAACTCCTGTATATATTCAAACAACCATTTATGAGACCAGTACAAACTACTCAAGAGGAAGA
TGGCTGTAGCTGCCGATTTCCAGAAGAAGAAGAAGGAGGATGTGAACTGGCCGGAGGGGCAAGG
GGCACGATGGCCTTTACCAGGGTCTCAGTACAGCCACCAAGGACACCTACGACGCCCTTCACATG
CAGGCCCTGCCCCCTCGCGCCGCCCGTCGGAGCCAGAGGCGGAGGGGGCGCCGGGGGGAGCCGGG
CACCGCCCTGCTGGTCCCGCTCGCGCTGGGCCTGGGCCTGGCGCTGGCCTGCCTCGGCCTCCTGCT
GGCCGTGGTCAGTTTGGGGAGCCGGGCATCGCTGTCCGCCCAGGAGCCTGCCCAGGAGGAGCTGG
TGGCAGAGGAGGACCAGGACCCGTCGGAACTGAATCCCCAGACAGAAGAAAGCCAGGATCCTGCG
CCTTTCCTGAACCGACTAGTTCGGCCTCGCAGAAGTGCACCTAAAGGCCGGAAAACACGGGCTCG
AAGAGCGATCGCAGCCCATTATGAAGTTCATCCACGACCTGGACAGGACGGAGCGCAGGCAGGTG
TGGACGGGACAGTGAGTGGCTGGGAGGAAGCCAGAATCAACAGCTCCAGCCCTCTGCGCTACAAC
CGCCAGATCGGGGAGTTTATAGTCACCCGGGCTGGGCTCTACTACCTGTACTGTCAGGTGCACTT
TGATGAGGGGAAGGCTGTCTACCTGAAGCTGGACTTGCTGGTGGATGGTGTGCTGGCCCTGCGCT
GCCTGGAGGAATTCTCAGCCACTGCGGCCAGTTCCCTCGGGCCCCAGCTCCGCCTCTGCCAGGTGT
CTGGGCTGTTGGCCCTGCGGCCAGGGTCCTCCCTGCGGATCCGCACCCTCCCCTGGGCCCATCTCA
AGGCTGCCCCCTTCCTCACCTACTTCGGACTCTTCCAGGTTCACTGA NbMMRm22.84-CD28H-CD28TM-DAP10CS-CD3zICS
(SEQ ID NO: 172) Protein sequence:
QVQLQESGGGLVQPGGSLRLSCAASGRTFSNYVNYAMGWFRQFPGKEREFVA*SISWSSVTT*YYADS
VKGRFTISRDNAKNTVYLQMNSLKPEDTAVYYCAAHLAQYSDYAYRDPHQFGAWGQGTQVTVS
SVKGKHLCPSPLFPGPSKPFWVLVVVGGVLACYSLLVTVAFIIFWVLCARPRRSPAQEDGKVYINM
PGRGLRVKFSRSADAPAYQQGQNQLYNELNLGRREEYDVLDKRRGRDPEMGGKPQRRKNPQEGL
YNELQKDKMAEAYSEIGMKGERRRGKGHDGLYQGLSTATKDTYDALHMQALPPR (SEQ ID NO: 272) DNA sequence:
CAGGTTCAGCTGCAAGAGTCTGGCGGAGGACTGGTTCAACCTGGCGGAAGCCTGAGACTGTCTTG
TGCCGCTTCTGGCAGAACCTTCAGCAACTACGTGAACTACGCCATGGGCTGGTTCAGACAGTTCC
CCGGCAAAGAGAGAGAGTTCGTCGCCAGCATCAGCTGGTCTAGCGTGACCACCTACTACGCCGAC
AGCGTGAAGGGCAGATTCACCATCAGCAGAGACAACGCCAAGAACACCGTGTACCTGCAGATGA
ACAGCCTGAAGCCAGAGGACACCGCCGTGTACTACTGTGCTGCTCACCTGGCTCAGTACAGCGAC
TACGCCTACAGAGATCCCCACCAGTTTGGCGCTTGGGGCCAGGGAACACAAGTGACCGTTAGCTC
TGTGAAAGGGAAACACCTTTGTCCAAGTCCCCTATTTCCCGGACCTTCTAAGCCCTTTTGGGTGC
TGGTGGTGGTTGGTGGAGTCCTGGCTTGCTATAGCTTGCTAGTAACAGTGGCCTTTATTATTTTC
TGGGTGCTGTGCGCACGCCCACGCCGCAGCCCCGCCCAAGAAGATGGCAAAGTCTACATCAACAT
GCCAGGCAGGGGCCTTAGAGTGAAGTTCAGCAGGAGCGCAGACGCCCCCGCGTACCAGCAGGGCC
AGAACCAGCTCTATAACGAGCTCAATCTAGGACGAAGAGAGGAGTACGATGTTTTGGACAAGAG
ACGTGGCCGGGACCCTGAGATGGGGGGAAAGCCGCAGAGAAGGAAGAACCCTCAGGAAGGCCTG
TACAATGAACTGCAGAAAGATAAGATGGCGGAGGCCTACAGTGAGATTGGGATGAAAGGCGAGC
GCCGGAGGGGCAAGGGGCACGATGGCCTTTACCAGGGTCTCAGTACAGCCACCAAGGACACCTAC
GACGCCCTTCACATGCAGGCCCTGCCCCCTCGC NbMMRm5.38-CD28H-CD28TM-DAP10CS-CD3zICS
(SEQ ID NO: 173) Protein sequence:
QVQLQESGGGLVQAGGSLRLSCAASGFTDDDYDIGWFRQAPGKEREGVS*CISSSDGST*YYADSVKG
RFTISSDNAKNTVYLQMNSLKPEDTAVYYCAADFFRWDSGSYYVRGCRHATYDYWGQGTQVTV
SSVKGKHLCPSPLFPGPSKPFWVLVVVGGVLACYSLLVTVAFIIFWVLCARPRRSPAQEDGKVYIN
MPGRGLRVKFSRSADAPAYQQGQNQLYNELNLGRREEYDVLDKRRGRDPEMGGKPQRRKNPQE
GLYNELQKDKMAEAYSEIGMKGERRRGKGHDGLYQGLSTATKDTYDALHMQALPPR (SEQ ID NO: 273) DNA sequence:
CAGGTTCAGCTGCAAGAGTCTGGCGGAGGACTGGTTCAAGCTGGCGGAAGCCTGAGACTGTCTTG
TGCCGCTTCTGGCTTCACCGACGACGACTACGATATCGGCTGGTTCAGACAGGCCCCTGGCAAAG
AGAGAGAGGGCGTCAGCTGTATCAGCAGCTCTGACGGCTCTACCTACTACGCCGACAGCGTGAAG
GGCAGATTCACCATCAGCAGCGACAACGCCAAGAACACCGTGTACCTGCAGATGAACTCTCTGAA
GCCCGAGGACACCGCCGTGTACTACTGTGCCGCCGACTTCTTCAGATGGGACAGCGGCAGCTACT
ACGTGCGGGGATGTAGACACGCCACCTACGATTACTGGGGCCAGGGCACACAAGTGACCGTGTCA
TCTGTGAAAGGGAAACACCTTTGTCCAAGTCCCCTATTTCCCGGACCTTCTAAGCCCTTTTGGGT
GCTGGTGGTGGTTGGTGGAGTCCTGGCTTGCTATAGCTTGCTAGTAACAGTGGCCTTTATTATTT
TCTGGGTGCTGTGCGCACGCCCACGCCGCAGCCCCGCCCAAGAAGATGGCAAAGTCTACATCAAC
ATGCCAGGCAGGGGCCTTAGAGTGAAGTTCAGCAGGAGCGCAGACGCCCCCGCGTACCAGCAGGG
CCAGAACCAGCTCTATAACGAGCTCAATCTAGGACGAAGAGAGGAGTACGATGTTTTGGACAAG
AGACGTGGCCGGGACCCTGAGATGGGGGGAAAGCCGCAGAGAAGGAAGAACCCTCAGGAAGGCC
TGTACAATGAACTGCAGAAAGATAAGATGGCGGAGGCCTACAGTGAGATTGGGATGAAAGGCGA
GCGCCGGAGGGGCAAGGGGCACGATGGCCTTTACCAGGGTCTCAGTACAGCCACCAAGGACACCT
ACGACGCCCTTCACATGCAGGCCCTGCCCCCTCGC scFvP4A8VHVL-CD28H-CD28TM-DAP10CS-CD3zICS
(SEQ ID NO: 174) Protein sequence:
QVQLQQSGPEVVRPGVSVKISCKGSGYTFTDYGMHWVKQSHAKSLEWIG*VISTYNGYTNYNQKFK*
*G*KATMTVDKSSSTAYMELARLTSEDSAIYYCARAYYGNLYYAMDYWGQGTSVTVSSGGGGSGGG
GSGGGGSDIVLTQSPASLAVSLGQRATISCRASKSVSTSSYSYMHWYQQKPGQPPKLLIKY*ASNLES*
GVPARFSGSGSGTDFILNIHPVEEEDAATYYCQHSRELPFTFGSGTKLEIKVKGKHLCPSPLFPGPS APPENDIX-continued

AMINO ACID AND NUCLEIC ACID SEQUENCES

KPFWVLVVVGGVLACYSLLVTVAFIIFWVLCARPRRSPAQEDGKVYINMPGRGLRVKFSRSADAPA
YQQGQNQLYNELNLGRREEYDVLDKRRGRDPEMGGKPQRRKNPQEGLYNELQKDKMAEAYSEI
GMKGERRRGKGHDGLYQGLSTATKDTYDALHMQALPPR (SEQ ID NO: 274) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATGCACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAGCAAAAGTGTCAGTACATCTAGCTATAGTTATAT
GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGCTGTGCGCACGCCCACGCCGCAGCCCCGCCC
AAGAAGATGGCAAAGTCTACATCAACATGCCAGGCAGGGGCCTTAGAGTGAAGTTCAGCAGGAG
CGCAGACGCCCCCGCGTACCAGCAGGGCCAGAACCAGCTCTATAACGAGCTCAATCTAGGACGAA
GAGAGGAGTACGATGTTTTGGACAAGAGACGTGGCCGGGACCCTGAGATGGGGGGAAAGCCGCA
GAGAAGGAAGAACCCTCAGGAAGGCCTGTACAATGAACTGCAGAAAGATAAGATGGCGGAGGCC
TACAGTGAGATTGGGATGAAAGGCGAGCGCCGGAGGGGCAAGGGGCACGATGGCCTTTACCAGG
GTCTCAGTACAGCCACCAAGGACACCTACGACGCCCTTCACATGCAGGCCCTGCCCCCTCGC scFvP4A8VLVH-CD28H-CD28TM-DAP10CS-CD3zICS
(SEQ ID NO: 175) Protein sequence:
DIVLTQSPASLAVSLGQRATISCRASKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGMHWVKQSHAKSLEWIG*VISTYNGYTNYNQKFKG*KATMTV
DKSSSTAYMELARLTSEDSAIYYCARAYYGNLYYAMDYWGQGTSVTVSSVKGKHLCPSPLFPGPS
KPFWVLVVVGGVLACYSLLVTVAFIIFWVLCARPRRSPAQEDGKVYINMPGRGLRVKFSRSADAPA
YQQGQNQLYNELNLGRREEYDVLDKRRGRDPEMGGKPQRRKNPQEGLYNELQKDKMAEAYSEI
GMKGERRRGKGHDGLYQGLSTATKDTYDALHMQALPPR (SEQ ID NO: 275) DNA sequence:
GACATTGTGCTGACACAGTCTCCTGCTTCCTTAGCTGTATCTCTGGGGCAGAGGGCCACCATCTC
ATGCAGGGCCAGCAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATGCACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGCTGTGCGCACGCCCACGCCGCAGCCCCGCCC
AAGAAGATGGCAAAGTCTACATCAACATGCCAGGCAGGGGCCTTAGAGTGAAGTTCAGCAGGAG
CGCAGACGCCCCCGCGTACCAGCAGGGCCAGAACCAGCTCTATAACGAGCTCAATCTAGGACGAA
GAGAGGAGTACGATGTTTTGGACAAGAGACGTGGCCGGGACCCTGAGATGGGGGGAAAGCCGCA
GAGAAGGAAGAACCCTCAGGAAGGCCTGTACAATGAACTGCAGAAAGATAAGATGGCGGAGGCC
TACAGTGAGATTGGGATGAAAGGCGAGCGCCGGAGGGGCAAGGGGCACGATGGCCTTTACCAGG
GTCTCAGTACAGCCACCAAGGACACCTACGACGCCCTTCACATGCAGGCCCTGCCCCCTCGC scFvP3G5VHVL-CD28H-CD28TM-DAP10CS-CD3zICS
(SEQ ID NO: 176) Protein sequence:
QVQLQQSGPEVVRPGVSVKISCKGSGYTFTDYGIHWVKQSHAKSLEWIG*VISTYNGYTNYNQKFKG*
KATMTVDKSSSTAYMELARLTSEDSAIYYCARAYYGNLYYAMDYWGQGTSVTVSSGGGGSGGGG
SGGGGSDIVLTQSPASLAVSLGQRATISCRANKSVSTSSYSYMHWYQQKPGQPPKLLIKY*ASNLES*G
VPARFSGSGSGTDFILNIHPVEEEDAATYYCQHSRELPFTFGSGTKLEIKVKGKHLCPSPLFPGPSK
PFWVLVVVGGVLACYSLLVTVAFIIFWVLCARPRRSPAQEDGKVYINMPGRGLRVKFSRSADAPAY
QQGQNQLYNELNLGRREEYDVLDKRRGRDPEMGGKPQRRKNPQEGLYNELQKDKMAEAYSEIG
MKGERRRGKGHDGLYQGLSTATKDTYDALHMQALPPR (SEQ ID NO: 176) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATACACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAACAAAAGTGTCAGTACATCTAGCTATAGTTATAT
GCACTGGTACCAACAGAAACCAGGACAGCCACCCAAACTCCTCATCAAGTATGCATCCAACCTAG

AMINO ACID AND NUCLEIC ACID SEQUENCES

AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGCTGTGCGCACGCCCACGCCGCAGCCCCGCCC
AAGAAGATGGCAAAGTCTACATCAACATGCCAGGCAGGGGCCTTAGAGTGAAGTTCAGCAGGAG
CGCAGACGCCCCCGCGTACCAGCAGGGCCAGAACCAGCTCTATAACGAGCTCAATCTAGGACGAA
GAGAGGAGTACGATGTTTTGGACAAGAGACGTGGCCGGGACCCTGAGATGGGGGGAAAGCCGCA
GAGAAGGAAGAACCCTCAGGAAGGCCTGTACAATGAACTGCAGAAAGATAAGATGGCGGAGGCC
TACAGTGAGATTGGGATGAAAGGCGAGCGCCGGAGGGGCAAGGGGCACGATGGCCTTTACCAGG
GTCTCAGTACAGCCACCAAGGACACCTACGACGCCCTTCACATGCAGGCCCTGCCCCCTCGC scFvP3G5VLVH-CD28H-CD28TM-DAP10CS-CD3zICS
(SEQ ID NO: 177) Protein sequence:
DIVLTQSPASLAVSLGQRATISCRANKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGIHWVKQSHAKSLEWIG*VISTYNGYTNYNQKFKG*KATMTVD
KSSSTAYMELARLTSEDSAIYYCARAYYGNLYYAMDYWGQGTSVTVSSVKGKHLCPSPLFPGPSK
PFWVLVVVGGVLACYSLLVTVAFIIFWVLCARPRRSPAQEDGKVYINMPGRGLRVKFSRSADAPAY
QQGQNQLYNELNLGRREEYDVLDKRRGRDPEMGGKPQRRKNPQEGLYNELQKDKMAEAYSEIG
MKGERRRGKGHDGLYQGLSTATKDTYDALHMQALPPR (SEQ ID NO: 277) DNA sequence:
GACATTGTGCTGACACAGTCTCCTGCTTCCTTAGCTGTATCTCTGGGGCAGAGGGCCACCATCTC
ATGCAGGGCCAACAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATACACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCAGTGAAAGGGAAACACCTTTGTCCAAGTCCCCTATTT
CCCGGACCTTCTAAGCCCTTTTGGGTGCTGGTGGTGGTTGGTGGAGTCCTGGCTTGCTATAGCTT
GCTAGTAACAGTGGCCTTTATTATTTTCTGGGTGCTGTGCGCACGCCCACGCCGCAGCCCCGCCC
AAGAAGATGGCAAAGTCTACATCAACATGCCAGGCAGGGGCCTTAGAGTGAAGTTCAGCAGGAG
CGCAGACGCCCCCGCGTACCAGCAGGGCCAGAACCAGCTCTATAACGAGCTCAATCTAGGACGAA
GAGAGGAGTACGATGTTTTGGACAAGAGACGTGGCCGGGACCCTGAGATGGGGGGAAAGCCGCA
GAGAAGGAAGAACCCTCAGGAAGGCCTGTACAATGAACTGCAGAAAGATAAGATGGCGGAGGCC
TACAGTGAGATTGGGATGAAAGGCGAGCGCCGGAGGGGCAAGGGGCACGATGGCCTTTACCAGG
GTCTCAGTACAGCCACCAAGGACACCTACGACGCCCTTCACATGCAGGCCCTGCCCCCTCGC CD3zICS-DAP10CS-TWEAK
(SEQ ID NO: 138) Protein sequence:
LRVKFSRSADAPAYQQGQNQLYNELNLGRREEYDVLDKRRGRDPEMGGKPQRRKNPQEGLYNEL
QKDKMAEAYSEIGMKGERRRGKGHDGLYQGLSTATKDTYDALHMQALPPRLCARPRRSPAQEDG
KVYINMPGRGAARRSQRRRGRRGEPGTALLVPLALGLGLALACLGLLLAVVSLGSRASLSAQEPAQ
EELVAEEDQDPSELNPQTEESQDPAPFLNRLVRPRRSAPKGRKTRARRAIAAHYEVHPRPGQDGA
QAGVDGTVSGWEEARINSSSPLRYNRQIGEFIVTRAGLYYLYCQVHFDEGKAVYLKLDLLVDGVLA
LRCLEEFSATAASSLGPQLRLCQVSGLLALRPGSSLRIRTLPWAHLKAAPFLTYFGLFQVH (SEQ ID NO: 238) DNA sequence:
CTTAGAGTGAAGTTCAGCAGGAGCGCAGACGCCCCCGCGTACCAGCAGGGCCAGAACCAGCTCTA
TAACGAGCTCAATCTAGGACGAAGAGAGGAGTACGATGTTTTGGACAAGAGACGTGGCCGGGAC
CCTGAGATGGGGGGAAAGCCGCAGAGAAGGAAGAACCCTCAGGAAGGCCTGTACAATGAACTGC
AGAAAGATAAGATGGCGGAGGCCTACAGTGAGATTGGGATGAAAGGCGAGCGCCGGAGGGGCAA
GGGGCACGATGGCCTTTACCAGGGTCTCAGTACAGCCACCAAGGACACCTACGACGCCCTTCACA
TGCAGGCCCTGCCCCCTCGCCTGTGCGCACGCCCACGCCGCAGCCCCGCCCAAGAAGATGGCAAAG
TCTACATCAACATGCCAGGCAGGGGCGCCGCCCGTCGGAGCCAGAGGCGGAGGGGGCGCCGGGGG
GAGCCGGGCACCGCCCTGCTGGTCCCGCTCGCGCTGGGCCTGGGCCTGGCGCTGGCCTGCCTCGGC
CTCCTGCTGGCCGTGGTCAGTTTGGGGAGCCGGGCATCGCTGTCCGCCCAGGAGCCTGCCCAGGA
GGAGCTGGTGGCAGAGGAGGACCAGGACCCGTCGGAACTGAATCCCCAGACAGAAGAAAGCCAG
GATCCTGCGCCTTTCCTGAACCGACTAGTTCGGCCTCGCAGAAGTGCACCTAAAGGCCGGAAAAC
ACGGGCTCGAAGAGCGATCGCAGCCCATTATGAAGTTCATCCACGACCTGGACAGGACGGAGCGC
AGGCAGGTGTGGACGGGACAGTGAGTGGCTGGGAGGAAGCCAGAATCAACAGCTCCAGCCCTCT
GCGCTACAACCGCCAGATCGGGGAGTTTATAGTCACCCGGGCTGGGCTCTACTACCTGTACTGTC
AGGTGCACTTTGATGAGGGGAAGGCTGTCTACCTGAAGCTGGACTTGCTGGTGGATGGTGTGCT
GGCCCTGCGCTGCCTGGAGGAATTCTCAGCCACTGCGGCCAGTTCCCTCGGGCCCCAGCTCCGCCT
CTGCCAGGTGTCTGGGCTGTTGGCCCTGCGGCCAGGGTCCTCCCTGCGGATCCGCACCCTCCCCTG
GGCCCATCTCAAGGCTGCCCCCTTCCTCACCTACTTCGGACTCTTCCAGGTTCACTGA APPENDIX-continued

AMINO ACID AND NUCLEIC ACID SEQUENCES

Full CARsequences, with the leader sequence (LS) if needed, T2A ribosomal skip sequence (T2A), and truncated CD19 (trCD19), suitable for use in humans LS-NbMMRm22.84-CD28H-CD28TM-CD28CS-CD3zICS-T2A-trCD19
(SEQ ID NO: 178) Protein sequence:
MEWTWVFLFLLSVTAGVHSQVQLQESGGGLVQPGGSLRLSCAASGRTFSNYVNYAMGWFRQFPG
KEREFVA*SISWSSVTT*YYADSVKGRFTISRDNAKNTVYLQMNSLKPEDTAVYYCAAHLAQYSDYA
YRDPHQFGAWGQGTQVTVSSVKGKHLCPSPLFPGPSKPFWVLVVVGGVLACYSLLVTVAFIIFWV
SKRSRLLHSDYMNMTPRRPGPTRKHYQPYAPPRDFAAYRSLRVKFSRSADAPAYQQGQNQLYNE
LNLGRREEYDVLDKRRGRDPEMGGKPQRRKNPQEGLYNELQKDKMAEAYSEIGMKGERRRGKG
HDGLYQGLSTATKDTYDALHMQALPPRARAKRSGSGEGRGSLLTCGDVEENPGPMPPPRLLFFLL
FLTPMEVRPEEPLVVKVEEGDNAVLQCLKGTSDGPTQQLTWSRESPLKPFLKLSLGLPGLGIHMR
PLAIWLFIFNVSQQMGGFYLCQPGPPSEKAWQPGWTVNVEGSGELFRWNVSDLGGLGCGLKNRS
SEGPSSPSGKLMSPKLYVWAKDRPEIWEGEPPCLPPRDSLNQSLSQDLTMAPGSTLWLSCGVPPD
SVSRGPLSWTHVHPKGPKSLLSLELKDDRPARDMWVMETGLLLPRATAQDAGKYYCHRGNLTM
SFHLEITARPVLWHWLLRTGGWKVSAVTLAYLIFCLCSLVGILHLQRALVLR RKRKRMT (SEQ ID NO: 278) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAACCTGGCGGAAGCCTGAGACTGTCTTGTGCCGCTT
CTGGCAGAACCTTCAGCAACTACGTGAACTACGCCATGGGCTGGTTCAGACAGTTCCCCGGCAAA
GAGAGAGAGTTCGTCGCCAGCATCAGCTGGTCTAGCGTGACCACCTACTACGCCGACAGCGTGAA
GGGCAGATTCACCATCAGCAGAGACAACGCCAAGAACACCGTGTACCTGCAGATGAACAGCCTGA
AGCCAGAGGACACCGCCGTGTACTACTGTGCTGCTCACCTGGCTCAGTACAGCGACTACGCCTAC
AGAGATCCCCACCAGTTTGGCGCTTGGGGCCAGGGAACACAAGTGACCGTTAGCTCTGTGAAAGG
GAAACACCTTTGTCCAAGTCCCCTATTTCCCGGACCTTCTAAGCCCTTTTGGGTGCTGGTGGTGG
TTGGTGGAGTCCTGGCTTGCTATAGCTTGCTAGTAACAGTGGCCTTTATTATTTTCTGGGTGAGG
AGTAAGAGGAGCAGGCTCCTGCACAGTGACTACATGAACATGACTCCCCGCCGCCCCGGGCCCAC
CCGCAAGCATTACCAGCCCTATGCCCCACCACGCGACTTCGCAGCCTATCGCTCCCTTAGAGTGAA
GTTCAGCAGGAGCGCAGACGCCCCCGCGTACCAGCAGGGCCAGAACCAGCTCTATAACGAGCTCA
ATCTAGGACGAAGAGAGGAGTACGATGTTTTGGACAAGAGACGTGGCCGGGACCCTGAGATGGG
GGGAAAGCCGCAGAGAAGGAAGAACCCTCAGGAAGGCCTGTACAATGAACTGCAGAAAGATAAG
ATGGCGGAGGCCTACAGTGAGATTGGGATGAAAGGCGAGCGCCGGAGGGGCAAGGGGCACGATG
GCCTTTACCAGGGTCTCAGTACAGCCACCAAGGACACCTACGACGCCCTTCACATGCAGGCCCTG
CCCCCTCGCGCCAGGGCCAAAAGGTCTGGCTCCGGTGAGGGCAGAGGAAGTCTTCTAACATGCGG
TGACGTGGAGGAGAATCCCGGCCCTATGCCACCTCCTCGCCTCCTCTTCTTCCTCCTCTTCCTCAC
CCCCATGGAAGTCAGGCCCGAGGAACCTCTAGTGGTGAAGGTGGAAGAGGGAGATAACGCTGTG
CTGCAGTGCCTCAAGGGGACCTCAGATGGCCCCACTCAGCAGCTGACCTGGTCTCGGGAGTCCCC
GCTTAAACCCTTCTTAAAACTCAGCCTGGGGCTGCCAGGCCTGGGAATCCACATGAGGCCCCTGG
CCATCTGGCTTTTCATCTTCAACGTCTCTCAACAGATGGGGGGCTTCTACCTGTGCCAGCCGGGG
CCCCCCTCTGAGAAGGCCTGGCAGCCTGGCTGGACAGTCAATGTGGAGGGCAGCGGGGAGCTGTT
CCGGTGGAATGTTTCGGACCTAGGTGGCCTGGGCTGTGGCCTGAAGAACAGGTCCTCAGAGGGCC
CCAGCTCCCCTTCCGGGAAGCTCATGAGCCCCAAGCTGTATGTGTGGGCCAAAGACCGCCCTGAG
ATCTGGGAGGGAGAGCCTCCGTGTCTCCCACCGAGGGACAGCCTGAACCAGAGCCTCAGCCAGGA
CCTCACCATGGCCCCTGGCTCCACACTCTGGCTGTCCTGTGGGGTACCCCCTGACTCTGTGTCCAG
GGGCCCCCTCTCCTGGACCCATGTGCACCCCAAGGGGCCTAAGTCATTGCTGAGCCTAGAGCTGA
AGGACGATCGCCCGGCCAGAGATATGTGGGTAATGGAGACGGGTCTGTTGTTGCCCCGGGCCACA
GCTCAAGACGCTGGAAAGTATTATTGTCACCGTGGCAACCTGACCATGTCATTCCACCTGGAGAT
CACTGCTCGGCCAGTACTATGGCACTGGCTGCTGAGGACTGGTGGCTGGAAGGTCTCAGCTGTGA
CTTTGGCTTATCTGATCTTCTGCCTGTGTTCCCTTGTGGGCATTCTTCATCTTCAAAGAGCCCTG
GTCCTGAGGAGGAAAAGAAAGCGAATGACTTAA LS-NbMMRm5.38-CD28H-CD28TM-CD28CS-CD3zICS-T2A-trCD19
(SEQ ID NO: 179) Protein sequence:
MEWTWVFLFLLSVTAGVHSQVQLQESGGGLVQAGGSLRLSCAASGFTDDDYDIGWFRQAPGKER
EGVS*CISSSDGST*YYADSVKGRFTISSDNAKNTVYLQMNSLKPEDTAVYYCAADFFRWDSGSYYVR
GCRHATYDYWGQGTQVTVSSVKGKHLCPSPLFPGPSKPFWVLVVVGGVLACYSLLVTVAFIIFWV
SKRSRLLHSDYMNMTPRRPGPTRKHYQPYAPPRDFAAYRSLRVKFSRSADAPAYQQGQNQLYNE
LNLGRREEYDVLDKRRGRDPEMGGKPQRRKNPQEGLYNELQKDKMAEAYSEIGMKGERRRGKG
HDGLYQGLSTATKDTYDALHMQALPPRARAKRSGSGEGRGSLLTCGDVEENPGPMPPPRLLFFLL
FLTPMEVRPEEPLVVKVEEGDNAVLQCLKGTSDGPTQQLTWSRESPLKPFLKLSLGLPGLGIHMR
PLAIWLFIFNVSQQMGGFYLCQPGPPSEKAWQPGWTVNVEGSGELFRWNVSDLGGLGCGLKNRS
SEGPSSPSGKLMSPKLYVWAKDRPEIWEGEPPCLPPRDSLNQSLSQDLTMAPGSTLWLSCGVPPD
SVSRGPLSWTHVHPKGPKSLLSLELKDDRPARDMVVVMETGLLLPRATAQDAGKYYCHRGNLTM
SFHLEITARPVLWHWLLRTGGWKVSAVTLAYLIFCLCSLVGILHLQRALVLR RKRKRMT (SEQ ID NO: 279) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAAGCTGGCGGAAGCCTGAGACTGTCTTGTGCCGCTT
CTGGCTTCACCGACGACGACTACGATATCGGCTGGTTCAGACAGGCCCCTGGCAAAGAGAGAGAG
GGCGTCAGCTGTATCAGCAGCTCTGACGGCTCTACCTACTACGCCGACAGCGTGAAGGGCAGATT
CACCATCAGCAGCGACAACGCCAAGAACACCGTGTACCTGCAGATGAACTCTCTGAAGCCCGAGG
ACACCGCCGTGTACTACTGTGCCGCCGACTTCTTCAGATGGGACAGCGGCAGCTACTACGTGCGG
GGATGTAGACACGCCACCTACGATTACTGGGGCCAGGGCACACAAGTGACCGTGTCATCTGTGAA
AGGGAAACACCTTTGTCCAAGTCCCCTATTTCCCGGACCTTCTAAGCCCTTTTGGGTGCTGGTGG
TGGTTGGTGGAGTCCTGGCTTGCTATAGCTTGCTAGTAACAGTGGCCTTTATTATTTTCTGGGTG
AGGAGTAAGAGGAGCAGGCTCCTGCACAGTGACTACATGAACATGACTCCCCGCCGCCCCGGGCC APPENDIX-continued

AMINO ACID AND NUCLEIC ACID SEQUENCES

CACCCGCAAGCATTACCAGCCCTATGCCCCACCACGCGACTTCGCAGCCTATCGCTCCCTTAGAGT
GAAGTTCAGCAGGAGCGCAGACGCCCCCGCGTACCAGCAGGGCCAGAACCAGCTCTATAACGAGC
TCAATCTAGGACGAAGAGAGGAGTACGATGTTTTGGACAAGAGACGTGGCCGGGACCCTGAGAT
GGGGGGAAAGCCGCAGAGAAGGAAGAACCCTCAGGAAGGCCTGTACAATGAACTGCAGAAAGAT
AAGATGGCGGAGGCCTACAGTGAGATTGGGATGAAAGGCGAGCGCCGGAGGGGCAAGGGGCACG
ATGGCCTTTACCAGGGTCTCAGTACAGCCACCAAGGACACCTACGACGCCCTTCACATGCAGGCC
CTGCCCCCTCGCGCCAGGGCCAAAAGGTCTGGCTCCGGTGAGGGCAGAGGAAGTCTTCTAACATG
CGGTGACGTGGAGGAGAATCCCGGCCCTATGCCACCTCCTCGCCTCCTCTTCTTCCTCCTCTTCCT
CACCCCCATGGAAGTCAGGCCCGAGGAACCTCTAGTGGTGAAGGTGGAAGAGGGAGATAACGCT
GTGCTGCAGTGCCTCAAGGGGACCTCAGATGGCCCCACTCAGCAGCTGACCTGGTCTCGGGAGTC
CCCGCTTAAACCCTTCTTAAAACTCAGCCTGGGGCTGCCAGGCCTGGGAATCCACATGAGGCCCC
TGGCCATCTGGCTTTTCATCTTCAACGTCTCTCAACAGATGGGGGGCTTCTACCTGTGCCAGCCG
GGGCCCCCCTCTGAGAAGGCCTGGCAGCCTGGCTGGACAGTCAATGTGGAGGGCAGCGGGGAGCT
GTTCCGGTGGAATGTTTCGGACCTAGGTGGCCTGGGCTGTGGCCTGAAGAACAGGTCCTCAGAGG
GCCCCAGCTCCCCTTCCGGGAAGCTCATGAGCCCCAAGCTGTATGTGTGGGCCAAAGACCGCCCT
GAGATCTGGGAGGGAGAGCCTCCGTGTCTCCCACCGAGGGACAGCCTGAACCAGAGCCTCAGCCA
GGACCTCACCATGGCCCCTGGCTCCACACTCTGGCTGTCCTGTGGGGTACCCCCTGACTCTGTGTC
CAGGGGCCCCCTCTCCTGGACCCATGTGCACCCCAAGGGGCCTAAGTCATTGCTGAGCCTAGAGC
TGAAGGACGATCGCCCGGCCAGAGATATGTGGGTAATGGAGACGGGTCTGTTGTTGCCCCGGGCC
ACAGCTCAAGACGCTGGAAAGTATTATTGTCACCGTGGCAACCTGACCATGTCATTCCACCTGGA
GATCACTGCTCGGCCAGTACTATGGCACTGGCTGCTGAGGACTGGTGGCTGGAAGGTCTCAGCTG
TGACTTTGGCTTATCTGATCTTCTGCCTGTGTTCCCTTGTGGGCATTCTTCATCTTCAAAGAGCC
CTGGTCCTGAGGAGGAAAAGAAAGCGAATGACTTAA

LS-scFvP4A8VHVL-CD28H-CD28TM-CD28CS-CD3zICS-T2A-trCD19
(SEQ ID NO: 180) Protein sequence:
MEWTWVFLFLLSVTAGVHSQVQLQQSGPEVVRPGVSVKISCKGSGYTFTDYGMHWVKQSHAKSL
EWIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRASKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVSKRSRLLHSDYMNMTPR
RPGPTRKHYQPYAPPRDFAAYRSLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPRARAKRSGSGEGRGSLLTCGDVEENPGPMPPPRLLFFLLFLTPMEVRPEEPLVVKV
EEGDNAVLQCLKGTSDGPTQQLTWSRESPLKPFLKLSLGLPGLGIHMRPLAIWLFIFNVSQQMGGF
YLCQPGPPSEKAWQPGWTVNVEGSGELFRWNVSDLGGLGCGLKNRSSEGPSSPSGKLMSPKLYV
WAKDRPEIWEGEPPCLPPRDSLNQSLSQDLTMAPGSTLWLSCGVPPDSVSRGPLSWTHVHPKGP
KSLLSLELKDDRPARDMWVMETGLLLPRATAQDAGKYYCHRGNLTMSFHLEITARPVLWHWLL
RTGGWKVSAVTLAYLIFCLCSLVGILHLQRALVLR RKRKRMT (SEQ ID NO: 280) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATGCACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAGCAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGAGGAGTAAGAGGAGCAGGCTCCTGCACAGTGACTACATG
AACATGACTCCCCGCCGCCCCGGGCCCACCCGCAAGCATTACCAGCCCTATGCCCCACCACGCGAC
TTCGCAGCCTATCGCTCCCTTAGAGTGAAGTTCAGCAGGAGCGCAGACGCCCCCGCGTACCAGCA
GGGCCAGAACCAGCTCTATAACGAGCTCAATCTAGGACGAAGAGAGGAGTACGATGTTTTGGAC
AAGAGACGTGGCCGGGACCCTGAGATGGGGGGAAAGCCGCAGAGAAGGAAGAACCCTCAGGAAG
GCCTGTACAATGAACTGCAGAAAGATAAGATGGCGGAGGCCTACAGTGAGATTGGGATGAAAGG
CGAGCGCCGGAGGGGCAAGGGGCACGATGGCCTTTACCAGGGTCTCAGTACAGCCACCAAGGACA
CCTACGACGCCCTTCACATGCAGGCCCTGCCCCCTCGCGCCAGGGCCAAAAGGTCTGGCTCCGGTG
AGGGCAGAGGAAGTCTTCTAACATGCGGTGACGTGGAGGAGAATCCCGGCCCTATGCCACCTCCT
CGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCA
GCAGCTGACCTGGTCTCGGGAGTCCCCGCTTAAACCCTTCTTAAAACTCAGCCTGGGGCTGCCAG
GCCTGGGAATCCACATGAGGCCCCTGGCCATCTGGCTTTTCATCTTCAACGTCTCTCAACAGATG
GGGGGCTTCTACCTGTGCCAGCCGGGGCCCCCCTCTGAGAAGGCCTGGCAGCCTGGCTGGACAGT
CAATGTGGAGGGCAGCGGGGAGCTGTTCCGGTGGAATGTTTCGGACCTAGGTGGCCTGGGCTGTG
GCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGA
CAGCCTGAACCAGAGCCTCAGCCAGGACCTCACCATGGCCCCTGGCTCCACACTCTGGCTGTCCTG
TGGGGTACCCCCTGACTCTGTGTCCAGGGGCCCCCTCTCCTGGACCCATGTGCACCCCAAGGGGCC
TAAGTCATTGCTGAGCCTAGAGCTGAAGGACGATCGCCCGGCCAGAGATATGTGGGTAATGGAG
ACGGGTCTGTTGTTGCCCCGGGCCACAGCTCAAGACGCTGGAAAGTATTATTGTCACCGTGGCAA APPENDIX-continued

| AMINO ACID AND NUCLEIC ACID SEQUENCES |
| --- |

CCTGACCATGTCATTCCACCTGGAGATCACTGCTCGGCCAGTACTATGGCACTGGCTGCTGAGGA
CTGGTGGCTGGAAGGTCTCAGCTGTGACTTTGGCTTATCTGATCTTCTGCCTGTGTTCCCTTGTG
GGCATTCTTCATCTTCAAAGAGCCCTGGTCCTGAGGAGGAAAAGAAAGCGAATGACTTAA

LS-scFvP4A8VLVH-CD28H-CD28TM-CD28CS-CD3zICS-T2A-trCD19
(SEQ ID NO: 181) Protein sequence:
MEWTWVVFLFLLSVTAGVHSDIVLTQSPASLAVSLGQRATISCRASKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGMHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVSKRSRLLHSDYMNMTPRR
PGPTRKHYQPYAPPRDFAAYRSLRVKFSRSADAPAYQQGQNQLYNELNLGRREEYDVLDKRRGR
DPEMGGKPQRRKNPQEGLYNELQKDKMAEAYSEIGMKGERRRGKGHDGLYQGLSTATKDTYDA
LHMQALPPRARAKRSGSGEGRGSLLTCGDVEENPGPMPPPRLLFFLLFLTPMEVRPEEPLVVKVE
EGDNAVLQCLKGTSDGPTQQLTWSRESPLKPFLKLSLGLPGLGIHMRPLAIWLFIFNVSQQMGGFY
LCQPGPPSEKAWQPGWTVNVEGSGELFRWNVSDLGGLGCGLKNRSSEGPSSPSGKLMSPKLYVW
AKDRPEIWEGEPPCLPPRDSLNQSLSQDLTMAPGSTLWLSCGVPPDSVSRGPLSWTHVHPKGPKS
LLSLELKDDRPARDMWVMETGLLLPRATAQDAGKYYCHRGNLTMSFHLEITARPVLWHWLLRT
GGWKVSAVTLAYLIFCLCSLVGILHLQRALVLR RKRKRMT (SEQ ID NO: 281) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAGCAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATGCACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTTGGTGGAGTCCTGGCTTGCTATAGCTTGCTAGTA
ACAGTGGCCTTTATTATTTTCTGGGTGAGGAGTAAGAGGAGCAGGCTCCTGCACAGTGACTACAT
GAACATGACTCCCCGCCGCCCCGGGCCCACCCGCAAGCATTACCAGCCCTATGCCCCACCACGCGA
CTTCGCAGCCTATCGCTCCCTTAGAGTGAAGTTCAGCAGGAGCGCAGACGCCCCCGCGTACCAGC
AGGGCCAGAACCAGCTCTATAACGAGCTCAATCTAGGACGAAGAGAGGAGTACGATGTTTTGGA
CAAGAGACGTGGCCGGGACCCTGAGATGGGGGGAAAGCCGCAGAGAAGGAAGAACCCTCAGGAA
GGCCTGTACAATGAACTGCAGAAAGATAAGATGGCGGAGGCCTACAGTGAGATTGGGATGAAAG
GCGAGCGCCGGAGGGGCAAGGGGCACGATGGCCTTTACCAGGGTCTCAGTACAGCCACCAAGGAC
ACCTACGACGCCCTTCACATGCAGGCCCTGCCCCCTCGCGCCAGGGCCAAAAGGTCTGGCTCCGGT
GAGGGCAGAGGAAGTCTTCTAACATGCGGTGACGTGGAGGAGAATCCCGGCCCTATGCCACCTCC
TCGCCTCCTCTTCTTCCTCCTCTTCCTCACCCCCATGGAAGTCAGGCCCGAGGAACCTCTAGTGGT
GAAGGTGGAAGAGGGAGATAACGCTGTGCTGCAGTGCCTCAAGGGGACCTCAGATGGCCCCACTC
AGCAGCTGACCTGGTCTCGGGAGTCCCCGCTTAAACCCTTCTTAAAACTCAGCCTGGGGCTGCCA
GGCCTGGGAATCCACATGAGGCCCCTGGCCATCTGGCTTTTCATCTTCAACGTCTCTCAACAGAT
GGGGGGCTTCTACCTGTGCCAGCCGGGGCCCCCCTCTGAGAAGGCCTGGCAGCCTGGCTGGACAG
TCAATGTGGAGGGCAGCGGGGAGCTGTTCCGGTGGAATGTTTCGGACCTAGGTGGCCTGGGCTGT
GGCCTGAAGAACAGGTCCTCAGAGGGCCCCAGCTCCCCTTCCGGGAAGCTCATGAGCCCCAAGCT
GTATGTGTGGGCCAAAGACCGCCCTGAGATCTGGGAGGGAGAGCCTCCGTGTCTCCCACCGAGGG
ACAGCCTGAACCAGAGCCTCAGCCAGGACCTCACCATGGCCCCTGGCTCCACACTCTGGCTGTCCT
GTGGGGTACCCCCTGACTCTGTGTCCAGGGGCCCCCTCTCCTGGACCCATGTGCACCCCAAGGGGC
CTAAGTCATTGCTGAGCCTAGAGCTGAAGGACGATCGCCCGGCCAGAGATATGTGGGTAATGGA
GACGGGTCTGTTGTTGCCCCGGGCCACAGCTCAAGACGCTGGAAAGTATTATTGTCACCGTGGCA
ACCTGACCATGTCATTCCACCTGGAGATCACTGCTCGGCCAGTACTATGGCACTGGCTGCTGAGG
ACTGGTGGCTGGAAGGTCTCAGCTGTGACTTTGGCTTATCTGATCTTCTGCCTGTGTTCCCTTGT
GGGCATTCTTCATCTTCAAAGAGCCCTGGTCCTGAGGAGGAAAAGAAAGCGAATGACTTAA LS-scFvP3GSVHVL-CD28H-CD28TM-CD28CS-CD3zICS-T2A-trCD19
(SEQ ID NO: 182) Protein sequence:
MEWTWVFLFLLSVTAGVHSQVQLQQSGPEVVRPGVSVKISCKGSGYTFTDYGIHWVKQSHAKSLE
WIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRANKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVSKRSRLLHSDYMNMTPR
RPGPTRKHYQPYAPPRDFAAYRSLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPRARAKRSGSGEGRGSLLTCGDVEENPGPMPPPRLLFFLLFLTPMEVRPEEPLVVKV
EEGDNAVLQCLKGTSDGPTQQLTWSRESPLKPFLKLSLGLPGLGIHMRPLAIWLFIFNVSQQMGGF
YLCQPGPPSEKAWQPGWTVNVEGSGELFRWNVSDLGGLGCGLKNRSSEGPSSPSGKLMSPKLYV
WAKDRPEIWEGEPPCLPPRDSLNQSLSQDLTMAPGSTLWLSCGVPPDSVSRGPLSWTHVHPKGP
KSLLSLELKDDRPARDMWVMETGLLLPRATAQDAGKYYCHRGNLTMSFHLEITARPVLWHWLL
RTGGWKVSAVTLAYLIFCLCSLVGILHLQRALVLR RKRKRMT APPENDIX-continued

AMINO ACID AND NUCLEIC ACID SEQUENCES (SEQ ID NO: 282) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATACACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAACAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGAGGAGTAAGAGGAGCAGGCTCCTGCACAGTGACTACATG
AACATGACTCCCCGCCGCCCCGGGCCCACCCGCAAGCATTACCAGCCCTATGCCCCACCACGCGAC
TTCGCAGCCTATCGCTCCCTTAGAGTGAAGTTCAGCAGGAGCGCAGACGCCCCCGCGTACCAGCA
GGGCCAGAACCAGCTCTATAACGAGCTCAATCTAGGACGAAGAGAGGAGTACGATGTTTTGGAC
AAGAGACGTGGCCGGGACCCTGAGATGGGGGGAAAGCCGCAGAGAAGGAAGAACCCTCAGGAAG
GCCTGTACAATGAACTGCAGAAAGATAAGATGGCGGAGGCCTACAGTGAGATTGGGATGAAAGG
CGAGCGCCGGAGGGGCAAGGGGCACGATGGCCTTTACCAGGGTCTCAGTACAGCCACCAAGGACA
CCTACGACGCCCTTCACATGCAGGCCCTGCCCCCTCGCGCCAGGGCCAAAAGGTCTGGCTCCGGTG
AGGGCAGAGGAAGTCTTCTAACATGCGGTGACGTGGAGGAGAATCCCGGCCCTATGCCACCTCCT
CGCCTCCTCTTCTTCCTCCTCTTCCTCACCCCCATGGAAGTCAGGCCCGAGGAACCTCTAGTGGTG
AAGGTGGAAGAGGGAGATAACGCTGTGCTGCAGTGCCTCAAGGGGACCTCAGATGGCCCCACTCA
GCAGCTGACCTGGTCTCGGGAGTCCCCGCTTAAACCCTTCTTAAAACTCAGCCTGGGGCTGCCAG
GCCTGGGAATCCACATGAGGCCCCTGGCCATCTGGCTTTTCATCTTCAACGTCTCTCAACAGATG
GGGGGCTTCTACCTGTGCCAGCCGGGGCCCCCCTCTGAGAAGGCCTGGCAGCCTGGCTGGACAGT
CAATGTGGAGGGCAGCGGGGAGCTGTTCCGGTGGAATGTTTCGGACCTAGGTGGCCTGGGCTGTG
GCCTGAAGAACAGGTCCTCAGAGGGCCCCAGCTCCCCTTCCGGGAAGCTCATGAGCCCCAAGCTG
TATGTGTGGGCCAAAGACCGCCCTGAGATCTGGGAGGGAGAGCCTCCGTGTCTCCCACCGAGGGA
CAGCCTGAACCAGAGCCTCAGCCAGGACCTCACCATGGCCCCTGGCTCCACACTCTGGCTGTCCTG
TGGGGTACCCCCTGACTCTGTGTCCAGGGGCCCCCTCTCCTGGACCCATGTGCACCCCAAGGGGCC
TAAGTCATTGCTGAGCCTAGAGCTGAAGGACGATCGCCCGGCCAGAGATATGTGGGTAATGGAG
ACGGGTCTGTTGTTGCCCCGGGCCACAGCTCAAGACGCTGGAAAGTATTATTGTCACCGTGGCAA
CCTGACCATGTCATTCCACCTGGAGATCACTGCTCGGCCAGTACTATGGCACTGGCTGCTGAGGA
CTGGTGGCTGGAAGGTCTCAGCTGTGACTTTGGCTTATCTGATCTTCTGCCTGTGTTCCCTTGTG
GGCATTCTTCATCTTCAAAGAGCCCTGGTCCTGAGGAGGAAAAGAAAGCGAATGACTTAA LS-scFvP3G5VLVH-CD28H-CD28TM-CD28CS-CD3zICS-T2A-trCD19
(SEQ ID NO: 183) Protein sequence:
MEWTWVFLFLLSVTAGVHSDIVLTQSPASLAVSLGQRATISCRANKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGIHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVSKRSRLLHSDYMNMTPRR
PGPTRKHYQPYAPPRDFAAYRSLRVKFSRSADAPAYQQGQNQLYNELNLGRREEYDVLDKRRGR
DPEMGGKPQRRKNPQEGLYNELQKDKMAEAYSEIGMKGERRRGKGHDGLYQGLSTATKDTYDA
LHMQALPPRARAKRSGSGEGRGSLLTCGDVEENPGPMPPPRLLFFLLFLTPMEVRPEEPLVVKVE
EGDNAVLQCLKGTSDGPTQQLTWSRESPLKPFLKLSLGLPGLGIHMRPLAIWLFIFNVSQQMGGFY
LCQPGPPSEKAWQPGWTVNVEGSGELFRWNVSDLGGLGCGLKNRSSEGPSSPSGKLMSPKLYVW
AKDRPEIWEGEPPCLPPRDSLNQSLSQDLTMAPGSTLWLSCGVPPDSVSRGPLSWTHVHPKGPKS
LLSLELKDDRPARDMWVMETGLLLPRATAQDAGKYYCHRGNLTMSFHLEITARPVLWHWLLRT
GGWKVSAVTLAYLIFCLCSLVGILHLQRALVLR RKRKRMT (SEQ ID NO: 283) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAACAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATACACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGAGGAGTAAGAGGAGCAGGCTCCTGCACAGTGACTACAT
GAACATGACTCCCCGCCGCCCCGGGCCCACCCGCAAGCATTACCAGCCCTATGCCCCACCACGCGA
CTTCGCAGCCTATCGCTCCCTTAGAGTGAAGTTCAGCAGGAGCGCAGACGCCCCCGCGTACCAGC
AGGGCCAGAACCAGCTCTATAACGAGCTCAATCTAGGACGAAGAGAGGAGTACGATGTTTTGGA
CAAGAGACGTGGCCGGGACCCTGAGATGGGGGGAAAGCCGCAGAGAAGGAAGAACCCTCAGGAA
GGCCTGTACAATGAACTGCAGAAAGATAAGATGGCGGAGGCCTACAGTGAGATTGGGATGAAAG APPENDIX-continued

AMINO ACID AND NUCLEIC ACID SEQUENCES

GCGAGCGCCGGAGGGGCAAGGGGCACGATGGCCTTTACCAGGGTCTCAGTACAGCCACCAAGGAC
ACCTACGACGCCCTTCACATGCAGGCCCTGCCCCCTCGCGCCAGGGCCAAAAGGTCTGGCTCCGGT
GAGGGCAGAGGAAGTCTTCTAACATGCGGTGACGTGGAGGAGAATCCCGGCCCTATGCCACCTCC
TCGCCTCCTCTTCTTCCTCCTCTTCCTCACCCCCATGGAAGTCAGGCCCGAGGAACCTCTAGTGGT
GAAGGTGGAAGAGGGAGATAACGCTGTGCTGCAGTGCCTCAAGGGGACCTCAGATGGCCCCACTC
AGCAGCTGACCTGGTCTCGGGAGTCCCCGCTTAAACCCTTCTTAAAACTCAGCCTGGGGCTGCCA
GGCCTGGGAATCCACATGAGGCCCCTGGCCATCTGGCTTTTCATCTTCAACGTCTCTCAACAGAT
GGGGGGCTTCTACCTGTGCCAGCCGGGGCCCCCCTCTGAGAAGGCCTGGCAGCCTGGCTGGACAG
TCAATGTGGAGGGCAGCGGGGAGCTGTTCCGGTGGAATGTTTCGGACCTAGGTGGCCTGGGCTGT
GGCCTGAAGAACAGGTCCTCAGAGGGCCCCAGCTCCCCTTCCGGGAAGCTCATGAGCCCCAAGCT
GTATGTGTGGGCCAAAGACCGCCCTGAGATCTGGGAGGGAGAGCCTCCGTGTCTCCCACCGAGGG
ACAGCCTGAACCAGAGCCTCAGCCAGGACCTCACCATGGCCCCTGGCTCCACACTCTGGCTGTCCT
GTGGGGTACCCCCTGACTCTGTGTCCAGGGGCCCCCTCTCCTGGACCCATGTGCACCCCAAGGGGC
CTAAGTCATTGCTGAGCCTAGAGCTGAAGGACGATCGCCCGGCCAGAGATATGTGGGTAATGGA
GACGGGTCTGTTGTTGCCCCGGGCCACAGCTCAAGACGCTGGAAAGTATTATTGTCACCGTGGCA
ACCTGACCATGTCATTCCACCTGGAGATCACTGCTCGGCCAGTACTATGGCACTGGCTGCTGAGG
ACTGGTGGCTGGAAGGTCTCAGCTGTGACTTTGGCTTATCTGATCTTCTGCCTGTGTTCCCTTGT
GGGCATTCTTCATCTTCAAAGAGCCCTGGTCCTGAGGAGGAAAAGAAAGCGAATGACTTAA

CD3zICS-CD28CS-TWEAK-T2A-trCD19
(SEQ ID NO: 196) Protein sequence:
LRVKFSRSADAPAYQQGQNQLYNELNLGRREEYDVLDKRRGRDPEMGGKPQRRKNPQEGLYNEL
QKDKMAEAYSEIGMKGERRRGKGHDGLYQGLSTATKDTYDALHMQALPPRSKRSRLLHSDYMN
MTPRRPGPTRKHYQPYAPPRDFAAYRSAARRSQRRRGRRGEPGTALLVPLALGLGLALACLGLLL
AVVSLGSRASLSAQEPAQEELVAEEDQDPSELNPQTEESQDPAPFLNRLVRPRRSAPKGRKTRAR
RAIAAHYEVHPRPGQDGAQAGVDGTVSGWEEARINSSSPLRYNRQIGEFIVTRAGLYYLYCQVHFD
EGKAVYLKLDLLVDGVLALRCLEEFSATAASSLGPQLRLCQVSGLLALRPGSSLRIRTLPWAHLKA
APFLTYFGLFQVHARAKRSGSGEGRGSLLTCGDVEENPGPMPPPRLLFFLLFLTPMEVRPEEPLVV
KVEEGDNAVLQCLKGTSDGPTQQLTWSRESPLKPFLKLSLGLPGLGIHMRPLAIWLFIFNVSQQM
GGFYLCQPGPPSEKAWQPGWTVNVEGSGELFRWNVSDLGGLGCGLKNRSSEGPSSPSGKLMSPKL
YVWAKDRPEIWEGEPPCLPPRDSLNQSLSQDLTMAPGSTLWLSCGVPPDSVSRGPLSWTHVHPK
GPKSLLSLELKDDRPARDMWVMETGLLLPRATAQDAGKYYCHRGNLTMSFHLEITARPVLWHW
LLRTGGWKVSAVTLAYLIFCLCSLVGILHLQRALVLR RKRKRMT (SEQ ID NO: 296) DNA sequence:
CTTAGAGTGAAGTTCAGCAGGAGCGCAGACGCCCCCGCGTACCAGCAGGGCCAGAACCAGCTCTA
TAACGAGCTCAATCTAGGACGAAGAGAGGAGTACGATGTTTTGGACAAGAGACGTGGCCGGGAC
CCTGAGATGGGGGGAAAGCCGCAGAGAAGGAAGAACCCTCAGGAAGGCCTGTACAATGAACTGC
AGAAAGATAAGATGGCGGAGGCCTACAGTGAGATTGGGATGAAAGGCGAGCGCCGGAGGGGCAA
GGGGCACGATGGCCTTTACCAGGGTCTCAGTACAGCCACCAAGGACACCTACGACGCCCTTCACA
TGCAGGCCCTGCCCCCTCGCAGGAGTAAGAGGAGCAGGCTCCTGCACAGTGACTACATGAACATG
ACTCCCCGCCGCCCCGGGCCCACCCGCAAGCATTACCAGCCCTATGCCCCACCACGCGACTTCGCA
GCCTATCGCTCCGCCGCCCGTCGGAGCCAGAGGCGGAGGGGGCGCCGGGGGGAGCCGGGCACCGC
CCTGCTGGTCCCGCTCGCGCTGGGCCTGGGCCTGGCGCTGGCCTGCCTCGGCCTCCTGCTGGCCGT
GGTCAGTTTGGGGAGCCGGGCATCGCTGTCCGCCCAGGAGCCTGCCCAGGAGGAGCTGGTGGCAG
AGGAGGACCAGGACCCGTCGGAACTGAATCCCCAGACAGAAGAAAGCCAGGATCCTGCGCCTTTC
CTGAACCGACTAGTTCGGCCTCGCAGAAGTGCACCTAAAGGCCGGAAAACACGGGCTCGAAGAGC
GATCGCAGCCCATTATGAAGTTCATCCACGACCTGGACAGGACGGAGCGCAGGCAGGTGTGGACG
GGACAGTGAGTGGCTGGGAGGAAGCCAGAATCAACAGCTCCAGCCCTCTGCGCTACAACCGCCAG
ATCGGGGAGTTTATAGTCACCCGGGCTGGGCTCTACTACCTGTACTGTCAGGTGCACTTTGATGA
GGGGAAGGCTGTCTACCTGAAGCTGGACTTGCTGGTGGATGGTGTGCTGGCCCTGCGCTGCCTGG
AGGAATTCTCAGCCACTGCGGCCAGTTCCCTCGGGCCCCAGCTCCGCCTCTGCCAGGTGTCTGGGC
TGTTGGCCCTGCGGCCAGGGTCCTCCCTGCGGATCCGCACCCTCCCCTGGGCCCATCTCAAGGCTG
CCCCCTTCCTCACCTACTTCGGACTCTTCCAGGTTCACTGAGCCAGGGCCAAAAGGTCTGGCTCCG
GTGAGGGCAGAGGAAGTCTTCTAACATGCGGTGACGTGGAGGAGAATCCCGGCCCTATGCCACCT
CCTCGCCTCCTCTTCTTCCTCCTCTTCCTCACCCCCATGGAAGTCAGGCCCGAGGAACCTCTAGTG
GTGAAGGTGGAAGAGGGAGATAACGCTGTGCTGCAGTGCCTCAAGGGGACCTCAGATGGCCCCAC
TCAGCAGCTGACCTGGTCTCGGGAGTCCCCGCTTAAACCCTTCTTAAAACTCAGCCTGGGGCTGC
CAGGCCTGGGAATCCACATGAGGCCCCTGGCCATCTGGCTTTTCATCTTCAACGTCTCTCAACAG
ATGGGGGGCTTCTACCTGTGCCAGCCGGGGCCCCCCTCTGAGAAGGCCTGGCAGCCTGGCTGGAC
AGTCAATGTGGAGGGCAGCGGGGAGCTGTTCCGGTGGAATGTTTCGGACCTAGGTGGCCTGGGCT
GTGGCCTGAAGAACAGGTCCTCAGAGGGCCCCAGCTCCCCTTCCGGGAAGCTCATGAGCCCCAAG
CTGTATGTGTGGGCCAAAGACCGCCCTGAGATCTGGGAGGGAGAGCCTCCGTGTCTCCCACCGAG
GGACAGCCTGAACCAGAGCCTCAGCCAGGACCTCACCATGGCCCCTGGCTCCACACTCTGGCTGTC
CTGTGGGGTACCCCCTGACTCTGTGTCCAGGGGCCCCCTCTCCTGGACCCATGTGCACCCCAAGGG
GCCTAAGTCATTGCTGAGCCTAGAGCTGAAGGACGATCGCCCGGCCAGAGATATGTGGGTAATGG
AGACGGGTCTGTTGTTGCCCCGGGCCACAGCTCAAGACGCTGGAAAGTATTATTGTCACCGTGGC
AACCTGACCATGTCATTCCACCTGGAGATCACTGCTCGGCCAGTACTATGGCACTGGCTGCTGAG
GACTGGTGGCTGGAAGGTCTCAGCTGTGACTTTGGCTTATCTGATCTTCTGCCTGTGTTCCCTTG
TGGGCATTCTTCATCTTCAAAGAGCCCTGGTCCTGAGGAGGAAAAGAAAGCGAATGACTTAA LS-NbMMRm22.84-CD28H-CD28TM-41BBCS-CD3zICS-T2A-trCD19
(SEQ ID NO: 184) Protein sequence:
MEWTWVFLFLLSVTAGVHSQVQLQESGGGLVQPGGSLRLSCAASGRTFSNYVNYAMGWFRQFPG
KEREFVA*SISWSSVTTY*YADSVKGRFTISRDNAKNTVYLQMNSLKPEDTAVYYCAAHLAQYSDYA
YRDPHQFGAWGQGTQVTVSSVKGKHLCPSPLFPGPSKPFWVLVVVGGVLACYSLLVTVAFIIFWV
KRGRKKLLYIFKQPFMRPVQTTQEEDGCSCRFPEEEEGGCELLRVKFSRSADAPAYQQGQNQLYN
ELNLGRREEYDVLDKRRGRDPEMGGKPQRRKNPQEGLYNELQKDKMAEAYSEIGMKGERRRGK APPENDIX-continued

| AMINO ACID AND NUCLEIC ACID SEQUENCES |
|---|
| GHDGLYQGLSTATKDTYDALHMQALPPRARAKRSGSGEGRGSLLTCGDVEENPGPMPPPRLLFFL<br>LFLTPMEVRPEEPLVVKVEEGDNAVLQCLKGTSDGPTQQLTWSRESPLKPFLKLSLGLPGLGIHM<br>RPLAIWLFIFNVSQQMGGFYLCQPGPPSEKAWQPGWTVNVEGSGELFRWNVSDLGGLGCGLKNR<br>SSEGPSSPSGKLMSPKLYVWAKDRPEIWEGEPPCLPPRDSLNQSLSQDLTMAPGSTLWLSCGVPP<br>DSVSRGPLSWTHVHPKGPKSLLSLELKDDRPARDMWVVETGLLLPRATAQDAGKYYCHRGNLT<br>MSFHLEITARPVLWHWLLRTGGWKVSAVTLAYLIFCLCSLVGILHLQRALVLR RKRKRMT |
| (SEQ ID NO: 284) DNA sequence:<br>ATGGAGTGGACCTGGGTGTTCCTGTTCCTGCTGAGCGTGACCGCCGGCGTGCACAGCCAGGTTCA<br>GCTGCAAGAGTCTGGCGGAGGACTGGTTCAACCTGGCGGAAGCCTGAGACTGTCTTGTGCCGCTT<br>CTGGCAGAACCTTCAGCAACTACGTGAACTACGCCATGGGCTGGTTCAGACAGTTCCCCGGCAAA<br>GAGAGAGAGTTCGTCGCCAGCATCAGCTGGTCTAGCGTGACCACCTACTACGCCGACAGCGTGAA<br>GGGCAGATTCACCATCAGCAGAGACAACGCCAAGAACACCGTGTACCTGCAGATGAACAGCCTGA<br>AGCCAGAGGACACCGCCGTGTACTACTGTGCTGCTCACCTGGCTCAGTACAGCGACTACGCCTAC<br>AGAGATCCCCACCAGTTTGGCGCTTGGGGCCAGGGAACACAAGTGACCGTTAGCTCTGTGAAAGG<br>GAAACACCTTTGTCCAAGTCCCCTATTTCCCGGACCTTCTAAGCCCTTTTGGGTGCTGGTGGTGG<br>TTGGTGGAGTCCTGGCTTGCTATAGCTTGCTAGTAACAGTGGCCTTTATTATTTTCTGGGTGAAA<br>CGGGGCAGAAAGAAACTCCTGTATATATTCAAACAACCATTTATGAGACCAGTACAAACTACTC<br>AAGAGGAAGATGGCTGTAGCTGCCGATTTCCAGAAGAAGAAGAAGGAGGATGTGAACTGCTTAG<br>AGTGAAGTTCAGCAGGAGCGCAGACGCCCCCGCGTACCAGCAGGGCCAGAACCAGCTCTATAACG<br>AGCTCAATCTAGGACGAAGAGAGGAGTACGATGTTTTGGACAAGAGACGTGGCCGGGACCCTGA<br>GATGGGGGGAAAGCCGCAGAGAAGGAAGAACCCTCAGGAAGGCCTGTACAATGAACTGCAGAAA<br>GATAAGATGGCGGAGGCCTACAGTGAGATTGGGATGAAAGGCGAGCGCCGGAGGGGCAAGGGGC<br>ACGATGGCCTTTACCAGGGTCTCAGTACAGCCACCAAGGACACCTACGACGCCCTTCACATGCAG<br>GCCCTGCCCCCTCGCGCCAGGGCCAAAAGGTCTGGCTCCGGTGAGGGCAGAGGAAGTCTTCTAAC<br>ATGCGGTGACGTGGAGGAGAATCCCGGCCCTATGCCACCTCCTCGCCTCCTCTTCTTCCTCCTCTT<br>CCTCACCCCCATGGAAGTCAGGCCCGAGGAACCTCTAGTGGTGAAGGTGGAAGAGGGAGATAACG<br>CTGTGCTGCAGTGCCTCAAGGGGACCTCAGATGGCCCCACTCAGCAGCTGACCTGGTCTCGGGAG<br>TCCCCGCTTAAACCCTTCTTAAAACTCAGCCTGGGGCTGCCAGGCCTGGGAATCCACATGAGGCC<br>CCTGGCCATCTGGCTTTTCATCTTCAACGTCTCTCAACAGATGGGGGGCTTCTACCTGTGCCAGC<br>CGGGGCCCCCCTCTGAGAAGGCCTGGCAGCCTGGCTGGACAGTCAATGTGGAGGGCAGCGGGGAG<br>CTGTTCCGGTGGAATGTTTCGGACCTAGGTGGCCTGGGCTGTGGCCTGAAGAACAGGTCCTCAGA<br>GGGCCCCAGCTCCCCTTCCGGGAAGCTCATGAGCCCCAAGCTGTATGTGTGGGCCAAAGACCGCC<br>CTGAGATCTGGGAGGGAGAGCCTCCGTGTCTCCCACCGAGGGACAGCCTGAACCAGAGCCTCAGC<br>CAGGACCTCACCATGGCCCCTGGCTCCACACTCTGGCTGTCCTGTGGGGTACCCCCTGACTCTGTG<br>TCCAGGGGCCCCCTCTCCTGGACCCATGTGCACCCCAAGGGGCCTAAGTCATTGCTGAGCCTAGA<br>GCTGAAGGACGATCGCCCGGCCAGAGATATGTGGGTAATGGAGACGGGTCTGTTGTTGCCCCGGG<br>CCACAGCTCAAGACGCTGGAAAGTATTATTGTCACCGTGGCAACCTGACCATGTCATTCCACCTG<br>GAGATCACTGCTCGGCCAGTACTATGGCACTGGCTGCTGAGGACTGGTGGCTGGAAGGTCTCAGC<br>TGTGACTTTGGCTTATCTGATCTTCTGCCTGTGTTCCCTTGTGGGCATTCTTCATCTTCAAAGAG<br>CCCTGGTCCTGAGGAGGAAAAGAAAGCGAATGACTTAA |
| LS-NbMMRm5.38-CD28H-CD28TM-41BBCS-CD3zICS-T2A-trCD19<br>(SEQ ID NO: 185) Protein sequence:<br>MEWTWVFLFLLSVTAGVHSQVQLQESGGGLVQAGGSLRLSCAASGFTDDDYDIGWFRQAPGKER<br>EGVS*CISSSDGST*YYADSVKGRFTISSDNAKNTVYLQMNSLKPEDTAVYYCAA**DFFRWDSGSYYVR**<br>**GCRHATYDY**WGQGTQVTVSSVKGKHLCPSPLFPGPSKPFWVLVVVGGVLACYSLLVTVAFIIFWV<br>KRGRKKLLYIFKQPFMRPVQTTQEEDGCSCRFPEEEEGGCELLRVKFSRSADAPAYQQGQNQLYN<br>ELNLGRREEYDVLDKRRGRDPEMGGKPQRRKNPQEGLYNELQKDKMAEAYSEIGMKGERRRGK<br>GHDGLYQGLSTATKDTYDALHMQALPPRARAKRSGSGEGRGSLLTCGDVEENPGPMPPPRLLFFL<br>LFLTPMEVRPEEPLVVKVEEGDNAVLQCLKGTSDGPTQQLTWSRESPLKPFLKLSLGLPGLGIHM<br>RPLAIWLFIFNVSQQMGGFYLCQPGPPSEKAWQPGWTVNVEGSGELFRWNVSDLGGLGCGLKNR<br>SSEGPSSPSGKLMSPKLYVWAKDRPEIWEGEPPCLPPRDSLNQSLSQDLTMAPGSTLWLSCGVPP<br>DSVSRGPLSWTHVHPKGPKSLLSLELKDDRPARDMWVVETGLLLPRATAQDAGKYYCHRGNLT<br>MSFHLEITARPVLWHWLLRTGGWKVSAVTLAYLIFCLCSLVGILHLQRALVLR RKRKRMT |
| (SEQ ID NO: 285) DNA sequence:<br>ATGGAGTGGACCTGGGTGTTCCTGTTCCTGCTGAGCGTGACCGCCGGCGTGCACAGCCAGGTTCA<br>GCTGCAAGAGTCTGGCGGAGGACTGGTTCAAGCTGGCGGAAGCCTGAGACTGTCTTGTGCCGCTT<br>CTGGCTTCACCGACGACGACTACGATATCGGCTGGTTCAGACAGGCCCCTGGCAAAGAGAGAGAG<br>GGCGTCAGCTGTATCAGCAGCTCTGACGGCTCTACCTACTACGCCGACAGCGTGAAGGGCAGATT<br>CACCATCAGCAGCGACAACGCCAAGAACACCGTGTACCTGCAGATGAACTCTCTGAAGCCCGAGG<br>ACACCGCCGTGTACTACTGTGCCGCCGACTTCTTCAGATGGGACAGCGGCAGCTACTACGTGCGG<br>GGATGTAGACACGCCACCTACGATTACTGGGGCCAGGGCACACAAGTGACCGTGTCATCTGTGAA<br>AGGGAAACACCTTTGTCCAAGTCCCCTATTTCCCGGACCTTCTAAGCCCTTTTGGGTGCTGGTGG<br>TGGTTGGTGGAGTCCTGGCTTGCTATAGCTTGCTAGTAACAGTGGCCTTTATTATTTTCTGGGTG<br>AAACGGGGCAGAAAGAAACTCCTGTATATATTCAAACAACCATTTATGAGACCAGTACAAACTA<br>CTCAAGAGGAAGATGGCTGTAGCTGCCGATTTCCAGAAGAAGAAGAAGGAGGATGTGAACTGCT<br>TAGAGTGAAGTTCAGCAGGAGCGCAGACGCCCCCGCGTACCAGCAGGGCCAGAACCAGCTCTATA<br>ACGAGCTCAATCTAGGACGAAGAGAGGAGTACGATGTTTTGGACAAGAGACGTGGCCGGGACCC<br>TGAGATGGGGGGAAAGCCGCAGAGAAGGAAGAACCCTCAGGAAGGCCTGTACAATGAACTGCAG<br>AAAGATAAGATGGCGGAGGCCTACAGTGAGATTGGGATGAAAGGCGAGCGCCGGAGGGGCAAGG<br>GGCACGATGGCCTTTACCAGGGTCTCAGTACAGCCACCAAGGACACCTACGACGCCCTTCACATG<br>CAGGCCCTGCCCCCTCGCGCCAGGGCCAAAAGGTCTGGCTCCGGTGAGGGCAGAGGAAGTCTTCT<br>AACATGCGGTGACGTGGAGGAGAATCCCGGCCCTATGCCACCTCCTCGCCTCCTCTTCTTCCTCCT<br>CTTCCTCACCCCCATGGAAGTCAGGCCCGAGGAACCTCTAGTGGTGAAGGTGGAAGAGGGAGATA<br>ACGCTGTGCTGCAGTGCCTCAAGGGGACCTCAGATGGCCCCACTCAGCAGCTGACCTGGTCTCGG<br>GAGTCCCCGCTTAAACCCTTCTTAAAACTCAGCCTGGGGCTGCCAGGCCTGGGAATCCACATGAG |

APPENDIX-continued

AMINO ACID AND NUCLEIC ACID SEQUENCES

GCCCCTGGCCATCTGGCTTTTCATCTTCAACGTCTCTCAACAGATGGGGGGCTTCTACCTGTGCC
AGCCGGGGCCCCCCTCTGAGAAGGCCTGGCAGCCTGGCTGGACAGTCAATGTGGAGGGCAGCGGG
GAGCTGTTCCGGTGGAATGTTTCGGACCTAGGTGGCCTGGGCTGTGGCCTGAAGAACAGGTCCTC
AGAGGGCCCCAGCTCCCCTTCCGGGAAGCTCATGAGCCCCAAGCTGTATGTGTGGGCCAAAGACC
GCCCTGAGATCTGGGAGGGAGAGCCTCCGTGTCTCCCACCGAGGGACAGCCTGAACCAGAGCCTC
AGCCAGGACCTCACCATGGCCCCTGGCTCCACACTCTGGCTGTCCTGTGGGGTACCCCCTGACTCT
GTGTCCAGGGGCCCCCTCTCCTGGACCCATGTGCACCCCAAGGGGCCTAAGTCATTGCTGAGCCT
AGAGCTGAAGGACGATCGCCCGGCCAGAGATATGTGGGTAATGGAGACGGGTCTGTTGTTGCCCC
GGGCCACAGCTCAAGACGCTGGAAAGTATTATTGTCACCGTGGCAACCTGACCATGTCATTCCAC
CTGGAGATCACTGCTCGGCCAGTACTATGGCACTGGCTGCTGAGGACTGGTGGCTGGAAGGTCTC
AGCTGTGACTTTGGCTTATCTGATCTTCTGCCTGTGTTCCCTTGTGGGCATTCTTCATCTTCAAA
GAGCCCTGGTCCTGAGGAGGAAAAGAAAGCGAATGACTTAA

LS-scFvP4A8VHVL-CD28H-CD28TM-41BBCS-CD3zICS-T2A-trCD19
(SEQ ID NO: 186) Protein sequence:
MEWTWVFLFLLSVTAGVHSQVQLQQSGPEVVRPGVSVKISCKGSGYTFTDYGMHWVKQSHAKSL
EWIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRASKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVKRGRKKLLYIFKQPFMRP
VQTTQEEDGCSCRFPEEEEGGCELLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPRARAKRSGSGEGRGSLLTCGDVEENPGPMPPPRLLFFLLFLTPMEVRPEEPLVVKV
EEGDNAVLQCLKGTSDGPTQQLTWSRESPLKPFLKLSLGLPGLGIHMRPLAIWLFIFNVSQQMGGF
YLCQPGPPSEKAWQPGWTVNVEGSGELFRWNVSDLGGLGCGLKNRSSEGPSSPSGKLMSPKLYV
WAKDRPEIWEGEPPCLPPRDSLNQSLSQDLTMAPGSTLWLSCGVPPDSVSRGPLSWTHVHPKGP
KSLLSLELKDDRPARDMWVMETGLLLPRATAQDAGKYYCHRGNLTMSFHLEITARPVLWHWLL
RTGGWKVSAVTLAYLIFCLCSLVGILHLQRALVLR RKRKRMT (SEQ ID NO: 286) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATGCACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAGCAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGAAACGGGGCAGAAAGAAACTCCTGTATATATTCAAACAA
CCATTTATGAGACCAGTACAAACTACTCAAGAGGAAGATGGCTGTAGCTGCCGATTTCCAGAAG
AAGAAGAAGGAGGATGTGAACTGCTTAGAGTGAAGTTCAGCAGGAGCGCAGACGCCCCCGCGTA
CCAGCAGGGCCAGAACCAGCTCTATAACGAGCTCAATCTAGGACGAAGAGAGGAGTACGATGTT
TTGGACAAGAGACGTGGCCGGGACCCTGAGATGGGGGGAAAGCCGCAGAGAAGGAAGAACCCTC
AGGAAGGCCTGTACAATGAACTGCAGAAAGATAAGATGGCGGAGGCCTACAGTGAGATTGGGAT
GAAAGGCGAGCGCCGGAGGGGCAAGGGGCACGATGGCCTTTACCAGGGTCTCAGTACAGCCACCA
AGGACACCTACGACGCCCTTCACATGCAGGCCCTGCCCCCTCGCGCCAGGGCCAAAAGGTCTGGC
TCCGGTGAGGGCAGAGGAAGTCTTCTAACATGCGGTGACGTGGAGGAGAATCCCGGCCCTATGCC
ACCTCCTCGCCTCCTCTTCTTCCTCCTCTTCCTCACCCCCATGGAAGTCAGGCCCGAGGAACCTCT
AGTGGTGAAGGTGGAAGAGGGAGATAACGCTGTGCTGCAGTGCCTCAAGGGGACCTCAGATGGC
CCCACTCAGCAGCTGACCTGGTCTCGGGAGTCCCCGCTTAAACCCTTCTTAAAACTCAGCCTGGG
GCTGCCAGGCCTGGGAATCCACATGAGGCCCCTGGCCATCTGGCTTTTCATCTTCAACGTCTCTC
AACAGATGGGGGGCTTCTACCTGTGCCAGCCGGGGCCCCCCTCTGAGAAGGCCTGGCAGCCTGGC
TGGACAGTCAATGTGGAGGGCAGCGGGGAGCTGTTCCGGTGGAATGTTTCGGACCTAGGTGGCCT
GGGCTGTGGCCTGAAGAACAGGTCCTCAGAGGGCCCCAGCTCCCCTTCCGGGAAGCTCATGAGCC
CCAAGCTGTATGTGTGGGCCAAAGACCGCCCTGAGATCTGGGAGGGAGAGCCTCCGTGTCTCCCA
CCGAGGGACAGCCTGAACCAGAGCCTCAGCCAGGACCTCACCATGGCCCCTGGCTCCACACTCTG
GCTGTCCTGTGGGGTACCCCCTGACTCTGTGTCCAGGGGCCCCCTCTCCTGGACCCATGTGCACCC
CAAGGGGCCTAAGTCATTGCTGAGCCTAGAGCTGAAGGACGATCGCCCGGCCAGAGATATGTGGG
TAATGGAGACGGGTCTGTTGTTGCCCCGGGCCACAGCTCAAGACGCTGGAAAGTATTATTGTCAC
CGTGGCAACCTGACCATGTCATTCCACCTGGAGATCACTGCTCGGCCAGTACTATGGCACTGGCT
GCTGAGGACTGGTGGCTGGAAGGTCTCAGCTGTGACTTTGGCTTATCTGATCTTCTGCCTGTGTT
CCCTTGTGGGCATTCTTCATCTTCAAAGAGCCCTGGTCCTGAGGAGGAAAAGAAAGCGAATGACT
TAA LS-scFvP4A8VLVH-CD28H-CD28TM-41BBCS-CD3zICS-T2A-trCD19
(SEQ ID NO: 187) Protein sequence:
MEWTWVFLFLLSVTAGVHSDIVLTQSPASLAVSLGQRATISCRASKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGMHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVKRGRKKLLYIFKQPFMRP
VQTTQEEDGCSCRFPEEEEGGCELLRVKFSRSADAPAYQQGQNQLYNELNLGRREEYDVLDKRRG APPENDIX-continued

AMINO ACID AND NUCLEIC ACID SEQUENCES

RDPEMGGKPQRRKNPQEGLYNELQKDKMAEAYSEIGMKGERRRGKGHDGLYQGLSTATKDTYD
ALHMQALPPRARAKRSGSGEGRGSLLTCGDVEENPGPMPPPRLLFFLLFLTPMEVRPEEPLVVKV
EEGDNAVLQCLKGTSDGPTQQLTWSRESPLKPFLKLSLGLPGLGIHMRPLAIWLFIFNVSQQMGGF
YLCQPGPPSEKAWQPGWTVNVEGSGELFRWNVSDLGGLGCGLKNRSSEGPSSPSGKLMSPKLYV
WAKDRPEIWEGEPPCLPPRDSLNQSLSQDLTMAPGSTLWLSCGVPPDSVSRGPLSWTHVHPKGP
KSLLSLELKDDRPARDMWVMETGLLLPRATAQDAGKYYCHRGNLTMSFHLEITARPVLWHWLL
RTGGWKVSAVTLAYLIFCLCSLVGILHLQRALVLR RKRKRMT (SEQ ID NO: 287) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAGCAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATGCACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGAAACGGGGCAGAAAGAAACTCCTGTATATATTCAAAC
AACCATTTATGAGACCAGTACAAACTACTCAAGAGGAAGATGGCTGTAGCTGCCGATTTCCAGA
AGAAGAAGAAGGAGGATGTGAACTGCTTAGAGTGAAGTTCAGCAGGAGCGCAGACGCCCCCGCG
TACCAGCAGGGCCAGAACCAGCTCTATAACGAGCTCAATCTAGGACGAAGAGAGGAGTACGATG
TTTTGGACAAGAGACGTGGCCGGGACCCTGAGATGGGGGGAAAGCCGCAGAGAAGGAAGAACCC
TCAGGAAGGCCTGTACAATGAACTGCAGAAAGATAAGATGGCGGAGGCCTACAGTGAGATTGGG
ATGAAAGGCGAGCGCCGGAGGGGCAAGGGGCACGATGGCCTTTACCAGGGTCTCAGTACAGCCAC
CAAGGACACCTACGACGCCCTTCACATGCAGGCCCTGCCCCCTCGCGCCAGGGCCAAAAGGTCTG
GCTCCGGTGAGGGCAGAGGAAGTCTTCTAACATGCGGTGACGTGGAGGAGAATCCCGGCCCTATG
CCACCTCCTCGCCTCCTCTTCTTCCTCCTCTTCCTCACCCCCATGGAAGTCAGGCCCGAGGAACCT
CTAGTGGTGAAGGTGGAAGAGGGAGATAACGCTGTGCTGCAGTGCCTCAAGGGGACCTCAGATG
GCCCCACTCAGCAGCTGACCTGGTCTCGGGAGTCCCCGCTTAAACCCTTCTTAAAACTCAGCCTG
GGGCTGCCAGGCCTGGGAATCCACATGAGGCCCCTGGCCATCTGGCTTTTCATCTTCAACGTCTC
TCAACAGATGGGGGGCTTCTACCTGTGCCAGCCGGGGCCCCCCTCTGAGAAGGCCTGGCAGCCTG
GCTGGACAGTCAATGTGGAGGGCAGCGGGGAGCTGTTCCGGTGGAATGTTTCGGACCTAGGTGG
CCTGGGCTGTGGCCTGAAGAACAGGTCCTCAGAGGGCCCCAGCTCCCCTTCCGGGAAGCTCATGA
GCCCCAAGCTGTATGTGTGGGCCAAAGACCGCCCTGAGATCTGGGAGGGAGAGCCTCCGTGTCTC
CCACCGAGGGACAGCCTGAACCAGAGCCTCAGCCAGGACCTCACCATGGCCCCTGGCTCCACACTC
TGGCTGTCCTGTGGGGTACCCCCTGACTCTGTGTCCAGGGGCCCCCTCTCCTGGACCCATGTGCAC
CCCAAGGGGCCTAAGTCATTGCTGAGCCTAGAGCTGAAGGACGATCGCCCGGCCAGAGATATGTG
GGTAATGGAGACGGGTCTGTTGTTGCCCCGGGCCACAGCTCAAGACGCTGGAAAGTATTATTGTC
ACCGTGGCAACCTGACCATGTCATTCCACCTGGAGATCACTGCTCGGCCAGTACTATGGCACTGG
CTGCTGAGGACTGGTGGCTGGAAGGTCTCAGCTGTGACTTTGGCTTATCTGATCTTCTGCCTGTG
TTCCCTTGTGGGCATTCTTCATCTTCAAAGAGCCCTGGTCCTGAGGAGGAAAAGAAAGCGAATGA
CTTAA LS-scFvP3GSVHVL-CD28H-CD28TM-41BBCS-CD3zICS-T2A-trCD19
(SEQ ID NO: 188) Protein sequence:
MEWTWVFLFLLSVTAGVHSQVQLQQSGPEVVRPGVSVKISCKGSGYTFTDYGIHWVKQSHAKSLE
WIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRANKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVKRGRKKLLYIFKQPFMRP
VQTTQEEDGCSCRFPEEEEGGCELLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPRARAKRSGSGEGRGSLLTCGDVEENPGPMPPPRLLFFLLFLTPMEVRPEEPLVVKV
EEGDNAVLQCLKGTSDGPTQQLTWSRESPLKPFLKLSLGLPGLGIHMRPLAIWLFIFNVSQQMGGF
YLCQPGPPSEKAWQPGWTVNVEGSGELFRWNVSDLGGLGCGLKNRSSEGPSSPSGKLMSPKLYV
WAKDRPEIWEGEPPCLPPRDSLNQSLSQDLTMAPGSTLWLSCGVPPDSVSRGPLSWTHVHPKGP
KSLLSLELKDDRPARDMVVVMETGLLLPRATAQDAGKYYCHRGNLTMSFHLEITARPVLWHWLL
RTGGWKVSAVTLAYLIFCLCSLVGILHLQRALVLR RKRKRMT (SEQ ID NO: 288) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATACACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAACAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG APPENDIX-continued

AMINO ACID AND NUCLEIC ACID SEQUENCES

GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGAAACGGGGCAGAAAGAAACTCCTGTATATATTCAAACAA
CCATTTATGAGACCAGTACAAACTACTCAAGAGGAAGATGGCTGTAGCTGCCGATTTCCAGAAG
AAGAAGAAGGAGGATGTGAACTGCTTAGAGTGAAGTTCAGCAGGAGCGCAGACGCCCCCGCGTA
CCAGCAGGGCCAGAACCAGCTCTATAACGAGCTCAATCTAGGACGAAGAGAGGAGTACGATGTT
TTGGACAAGAGACGTGGCCGGGACCCTGAGATGGGGGGAAAGCCGCAGAGAAGGAAGAACCCTC
AGGAAGGCCTGTACAATGAACTGCAGAAAGATAAGATGGCGGAGGCCTACAGTGAGATTGGGAT
GAAAGGCGAGCGCCGGAGGGGCAAGGGGCACGATGGCCTTTACCAGGGTCTCAGTACAGCCACCA
AGGACACCTACGACGCCCTTCACATGCAGGCCCTGCCCCCTCGCGCCAGGGCCAAAGGTCTGGC
TCCGGTGAGGGCAGAGGAAGTCTTCTAACATGCGGTGACGTGGAGGAGAATCCCGGCCCTATGCC
ACCTCCTCGCCTCCTCTTCTTCCTCCTCTTCCTCACCCCCATGGAAGTCAGGCCCGAGGAACCTCT
AGTGGTGAAGGTGGAAGAGGGAGATAACGCTGTGCTGCAGTGCCTCAAGGGGACCTCAGATGGC
CCCACTCAGCAGCTGACCTGGTCTCGGGAGTCCCCGCTTAAACCCTTCTTAAAACTCAGCCTGGG
GCTGCCAGGCCTGGGAATCCACATGAGGCCCCTGGCCATCTGGCTTTTCATCTTCAACGTCTCTC
AACAGATGGGGGGCTTCTACCTGTGCCAGCCGGGGCCCCCCTCTGAGAAGGCCTGGCAGCCTGGC
TGGACAGTCAATGTGGAGGGCAGCGGGGAGCTGTTCCGGTGGAATGTTTCGGACCTAGGTGGCCT
GGGCTGTGGCCTGAAGAACAGGTCCTCAGAGGGCCCCAGCTCCCCTTCCGGGAAGCTCATGAGCC
CCAAGCTGTATGTGTGGGCCAAAGACCGCCCTGAGATCTGGGAGGGAGAGCCTCCGTGTCTCCCA
CCGAGGGACAGCCTGAACCAGAGCCTCAGCCAGGACCTCACCATGGCCCCTGGCTCCACACTCTG
GCTGTCCTGTGGGGTACCCCCTGACTCTGTGTCCAGGGGCCCCCTCTCCTGGACCCATGTGCACCC
CAAGGGGCCTAAGTCATTGCTGAGCCTAGAGCTGAAGGACGATCGCCCGGCCAGAGATATGTGGG
TAATGGAGACGGGTCTGTTGTTGCCCCGGGCCACAGCTCAAGACGCTGGAAAGTATTATTGTCAC
CGTGGCAACCTGACCATGTCATTCCACCTGGAGATCACTGCTCGGCCAGTACTATGGCACTGGCT
GCTGAGGACTGGTGGCTGGAAGGTCTCAGCTGTGACTTTGGCTTATCTGATCTTCTGCCTGTGTT
CCCTTGTGGGCATTCTTCATCTTCAAAGAGCCCTGGTCCTGAGGAGGAAAAGAAAGCGAATGACT
TAA

LS-scFvP3G5VLVH-CD28H-CD28TM-41BBCS-CD3zICS-T2A-trCD19
(SEQ ID NO: 189) Protein sequence:
MEWTWVFLFLLSVTAGVHSDIVLTQSPASLAVSLGQRATISCRANKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGIHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVKRGRKKLLYIFKQPFMRP
VQTTQEEDGCSCRFPEEEEGGCELLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPRARAKRSGSGEGRGSLLTCGDVEENPGPMPPPRLLFFLLFLTPMEVRPEEPLVVKV
EEGDNAVLQCLKGTSDGPTQQLTWSRESPLKPFLKLSLGLPGLGIHMRPLAIWLFIFNVSQQMGGF
YLCQPGPPSEKAWQPGWTVNVEGSGELFRWNVSDLGGLGCGLKNRSSEGPSSPSGKLMSPKLYV
WAKDRPEIWEGEPPCLPPRDSLNQSLSQDLTMAPGSTLWLSCGVPPDSVSRGPLSWTHVHPKGP
KSLLSLELKDDRPARDMWVMETGLLLPRATAQDAGKYYCHRGNLTMSFHLEITARPVLWHWLL
RTGGWKVSAVTLAYLIFCLCSLVGILHLQRALVLR RKRKRMT (SEQ ID NO: 289) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAACAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATACACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGAAACGGGGCAGAAAGAAACTCCTGTATATATTCAAAC
AACCATTTATGAGACCAGTACAAACTACTCAAGAGGAAGATGGCTGTAGCTGCCGATTTCCAGA
AGAAGAAGAAGGAGGATGTGAACTGCTTAGAGTGAAGTTCAGCAGGAGCGCAGACGCCCCCGCG
TACCAGCAGGGCCAGAACCAGCTCTATAACGAGCTCAATCTAGGACGAAGAGAGGAGTACGATG
TTTTGGACAAGAGACGTGGCCGGGACCCTGAGATGGGGGGAAAGCCGCAGAGAAGGAAGAACCC
TCAGGAAGGCCTGTACAATGAACTGCAGAAAGATAAGATGGCGGAGGCCTACAGTGAGATTGGG
ATGAAAGGCGAGCGCCGGAGGGGCAAGGGGCACGATGGCCTTTACCAGGGTCTCAGTACAGCCAC
CAAGGACACCTACGACGCCCTTCACATGCAGGCCCTGCCCCCTCGCGCCAGGGCCAAAGGTCTG
GCTCCGGTGAGGGCAGAGGAAGTCTTCTAACATGCGGTGACGTGGAGGAGAATCCCGGCCCTATG
CCACCTCCTCGCCTCCTCTTCTTCCTCCTCTTCCTCACCCCCATGGAAGTCAGGCCCGAGGAACCT
CTAGTGGTGAAGGTGGAAGAGGGAGATAACGCTGTGCTGCAGTGCCTCAAGGGGACCTCAGATG
GCCCCACTCAGCAGCTGACCTGGTCTCGGGAGTCCCCGCTTAAACCCTTCTTAAAACTCAGCCTG
GGGCTGCCAGGCCTGGGAATCCACATGAGGCCCCTGGCCATCTGGCTTTTCATCTTCAACGTCTC
TCAACAGATGGGGGGCTTCTACCTGTGCCAGCCGGGGCCCCCCTCTGAGAAGGCCTGGCAGCCTG
GCTGGACAGTCAATGTGGAGGGCAGCGGGGAGCTGTTCCGGTGGAATGTTTCGGACCTAGGTGG
CCTGGGCTGTGGCCTGAAGAACAGGTCCTCAGAGGGCCCCAGCTCCCCTTCCGGGAAGCTCATGA
GCCCCAAGCTGTATGTGTGGGCCAAAGACCGCCCTGAGATCTGGGAGGGAGAGCCTCCGTGTCTC
CCACCGAGGGACAGCCTGAACCAGAGCCTCAGCCAGGACCTCACCATGGCCCCTGGCTCCACACTC
TGGCTGTCCTGTGGGGTACCCCCTGACTCTGTGTCCAGGGGCCCCCTCTCCTGGACCCATGTGCAC

AMINO ACID AND NUCLEIC ACID SEQUENCES

CCCAAGGGGCCTAAGTCATTGCTGAGCCTAGAGCTGAAGGACGATCGCCCGGCCAGAGATATGTG
GGTAATGGAGACGGGTCTGTTGTTGCCCCGGGCCACAGCTCAAGACGCTGGAAAGTATTATTGTC
ACCGTGGCAACCTGACCATGTCATTCCACCTGGAGATCACTGCTCGGCCAGTACTATGGCACTGG
CTGCTGAGGACTGGTGGCTGGAAGGTCTCAGCTGTGACTTTGGCTTATCTGATCTTCTGCCTGTG
TTCCCTTGTGGGCATTCTTCATCTTCAAAGAGCCCTGGTCCTGAGGAGGAAAAGAAAGCGAATGA
CTTAA

CD3zICS-41BBCS -TWEAK-T2A-trCD19
(SEQ ID NO: 197) Protein sequence:
LRVKFSRSADAPAYQQGQNQLYNELNLGRREEYDVLDKRRGRDPEMGGKPQRRKNPQEGLYNEL
QKDKMAEAYSEIGMKGERRRGKGHDGLYQGLSTATKDTYDALHMQALPPRKRGRKKLLYIFKQP
FMRPVQTTQEEDGCSCRFPEEEEGGCELAARRSQRRRGRRGEPGTALLVPLALGLGLALACLGLLL
AVVSLGSRASLSAQEPAQEELVAEEDQDPSELNPQTEESQDPAPFLNRLVRPRRSAPKGRKTRAR
RAIAAHYEVHPRPGQDGAQAGVDGTVSGWEEARINSSSPLRYNRQIGEFIVTRAGLYYLYCQVHFD
EGKAVYLKLDLLVDGVLALRCLEEFSATAASSLGPQLRLCQVSGLLALRPGSSLRIRTLPWAHLKA
APFLTYFGLFQVHARAKRSGSGEGRGSLLTCGDVEENPGPMPPPRLLFFLLFLTPMEVRPEEPLVV
KVEEGDNAVLQCLKGTSDGPTQQLTWSRESPLKPFLKLSLGLPGLGIHMRPLAIWLFIFNVSQQM
GGFYLCQPGPPSEKAWQPGWTVNVEGSGELFRWNVSDLGGLGCGLKNRSSEGPSSPSGKLMSPKL
YVWAKDRPEIWEGEPPCLPPRDSLNQSLSQDLTMAPGSTLWLSCGVPPDSVSRGPLSWTHVHPK
GPKSLLSLELKDDRPARDMWVMETGLLLPRATAQDAGKYYCHRGNLTMSFHLEITARPVLWHW
LLRTGGWKVSAVTLAYLIFCLCSLVGILHLQRALVLR RKRKRMT (SEQ ID NO: 297) DNA sequence:
CTTAGAGTGAAGTTCAGCAGGAGCGCAGACGCCCCCGCGTACCAGCAGGGCCAGAACCAGCTCTA
TAACGAGCTCAATCTAGGACGAAGAGAGGAGTACGATGTTTTGGACAAGAGACGTGGCCGGGAC
CCTGAGATGGGGGGAAAGCCGCAGAGAAGGAAGAACCCTCAGGAAGGCCTGTACAATGAACTGC
AGAAAGATAAGATGGCGGAGGCCTACAGTGAGATTGGGATGAAAGGCGAGCAAACGGGGCAGAA
AGAAACTCCTGTATATATTCAAACAACCATTTATGAGACCAGTACAAACTACTCAAGAGGAAGA
TGGCTGTAGCTGCCGATTTCCAGAAGAAGAAGAAGGAGGATGTGAACTGGCCGGAGGGGCAAGG
GGCACGATGGCCTTTACCAGGGTCTCAGTACAGCCACCAAGGACACCTACGACGCCCTTCACATG
CAGGCCCTGCCCCCTCGCGCCGCCCGTCGGAGCCAGAGGCGGAGGGGGCGCCGGGGGGAGCCGGG
CACCGCCCTGCTGGTCCCGCTCGCGCTGGGCCTGGGCCTGGCGCTGGCCTGCCTCGGCCTCCTGCT
GGCCGTGGTCAGTTTGGGGAGCCGGGCATCGCTGTCCGCCCAGGAGCCTGCCCAGGAGGAGCTGG
TGGCAGAGGAGGACCAGGACCCGTCGGAACTGAATCCCCAGACAGAAGAAAGCCAGGATCCTGCG
CCTTTCCTGAACCGACTAGTTCGGCCTCGCAGAAGTGCACCTAAAGGCCGGAAAACACGGGCTCG
AAGAGCGATCGCAGCCCATTATGAAGTTCATCCACGACCTGGACAGGACGGAGCGCAGGCAGGTG
TGGACGGGACAGTGAGTGGCTGGGAGGAAGCCAGAATCAACAGCTCCAGCCCTCTGCGCTACAAC
CGCCAGATCGGGGAGTTTATAGTCACCCGGGCTGGGCTCTACTACCTGTACTGTCAGGTGCACTT
TGATGAGGGGAAGGCTGTCTACCTGAAGCTGGACTTGCTGGTGGATGGTGTGCTGGCCCTGCGCT
GCCTGGAGGAATTCTCAGCCACTGCGGCCAGTTCCCTCGGGCCCCAGCTCCGCCTCTGCCAGGTGT
CTGGGCTGTTGGCCCTGCGGCCAGGGTCCTCCCTGCGGATCCGCACCCTCCCCTGGGCCCATCTCA
AGGCTGCCCCCTTCCTCACCTACTTCGGACTCTTCCAGGTTCACTGAGCCAGGGCCAAAAGGTCT
GGCTCCGGTGAGGGCAGAGGAAGTCTTCTAACATGCGGTGACGTGGAGGAGAATCCCGGCCCTAT
GCCACCTCCTCGCCTCCTCTTCTTCCTCCTCTTCCTCACCCCCATGGAAGTCAGGCCCGAGGAACC
TCTAGTGGTGAAGGTGGAAGAGGGAGATAACGCTGTGCTGCAGTGCCTCAAGGGGACCTCAGAT
GGCCCCACTCAGCAGCTGACCTGGTCTCGGGAGTCCCCGCTTAAACCCTTCTTAAAACTCAGCCT
GGGGCTGCCAGGCCTGGGAATCCACATGAGGCCCCTGGCCATCTGGCTTTTCATCTTCAACGTCT
CTCAACAGATGGGGGGCTTCTACCTGTGCCAGCCGGGGCCCCCCTCTGAGAAGGCCTGGCAGCCT
GGCTGGACAGTCAATGTGGAGGGCAGCGGGGAGCTGTTCCGGTGGAATGTTTCGGACCTAGGTG
GCCTGGGCTGTGGCCTGAAGAACAGGTCCTCAGAGGGCCCCAGCTCCCCTTCCGGGAAGCTCATG
AGCCCCAAGCTGTATGTGTGGGCCAAAGACCGCCCTGAGATCTGGGAGGGAGAGCCTCCGTGTCT
CCCACCGAGGGACAGCCTGAACCAGAGCCTCAGCCAGGACCTCACCATGGCCCCTGGCTCCACACT
CTGGCTGTCCTGTGGGGTACCCCCTGACTCTGTGTCCAGGGGCCCCCTCTCCTGGACCCATGTGCA
CCCCAAGGGGCCTAAGTCATTGCTGAGCCTAGAGCTGAAGGACGATCGCCCGGCCAGAGATATGT
GGGTAATGGAGACGGGTCTGTTGTTGCCCCGGGCCACAGCTCAAGACGCTGGAAAGTATTATTGT
CACCGTGGCAACCTGACCATGTCATTCCACCTGGAGATCACTGCTCGGCCAGTACTATGGCACTG
GCTGCTGAGGACTGGTGGCTGGAAGGTCTCAGCTGTGACTTTGGCTTATCTGATCTTCTGCCTGT
GTTCCCTTGTGGGCATTCTTCATCTTCAAAGAGCCCTGGTCCTGAGGAGGAAAAGAAAGCGAATG
ACTTAA LS-NbMMRm22.84-CD28H-CD28TM-DAP10CS-CD3zICS-T2A-trCD19
(SEQ ID NO: 190) Protein sequence:
MEWTWVFLFLLSVTAGVHSQVQLQESGGGLVQPGGSLRLSCAASGRTFSNYVNYAMGWFRQFPG
KEREFVASISWSSVTTYYADSVKGRFTISRDNAKNTVYLQMNSLKPEDTAVYYCAAHLAQYSDYA
YRDPHQFGAWGQGTQVTVSSVKGKHLCPSPLFPGPSKPFWVLVVVGGVLACYSLLVTVAFIIFWV
LCARPRRSPAQEDGKVYINMPGRGLRVKFSRSADAPAYQQGQNQLYNELNLGRREEYDVLDKRR
GRDPEMGGKPQRRKNPQEGLYNELQKDKMAEAYSEIGMKGERRRGKGHDGLYQGLSTATKDTY
DALHMQALPPRARAKRSGSGEGRGSLLTCGDVEENPGPMPPPRLLFFLLFLTPMEVRPEEPLVVK
VEEGDNAVLQCLKGTSDGPTQQLTWSRESPLKPFLKLSLGLPGLGIHMRPLAIWLFIFNVSQQMG
GFYLCQPGPPSEKAWQPGWTVNVEGSGELFRWNVSDLGGLGCGLKNRSSEGPSSPSGKLMSPKLY
VWAKDRPEIWEGEPPCLPPRDSLNQSLSQDLTMAPGSTLWLSCGVPPDSVSRGPLSWTHVHPKG
PKSLLSLELKDDRPARDMWVMETGLLLPRATAQDAGKYYCHRGNLTMSFHLEITARPVLWHWL
LRTGGWKVSAVTLAYLIFCLCSLVGILHLQRALVLR RKRKRMT (SEQ ID NO: 290) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAACCTGGCGGAAGCCTGAGACTGTCTTGTGCCGCTT
CTGGCAGAACCTTCAGCAACTACGTGAACTACGCCATGGGCTGGTTCAGACAGTTCCCCGGCAAA APPENDIX-continued

AMINO ACID AND NUCLEIC ACID SEQUENCES

GAGAGAGAGTTCGTCGCCAGCATCAGCTGGTCTAGCGTGACCACCTACTACGCCGACAGCGTGAA
GGGCAGATTCACCATCAGCAGAGACAACGCCAAGAACACCGTGTACCTGCAGATGAACAGCCTGA
AGCCAGAGGACACCGCCGTGTACTACTGTGCTGCTCACCTGGCTCAGTACAGCGACTACGCCTAC
AGAGATCCCCACCAGTTTGGCGCTTGGGGCCAGGGAACACAAGTGACCGTTAGCTCTGTGAAAGG
GAAACACCTTTGTCCAAGTCCCCTATTTCCCGGACCTTCTAAGCCCTTTTGGGTGCTGGTGGTGG
TTGGTGGAGTCCTGGCTTGCTATAGCTTGCTAGTAACAGTGGCCTTTATTATTTTCTGGGTGCTG
TGCGCACGCCCACGCCGCAGCCCCGCCCAAGAAGATGGCAAAGTCTACATCAACATGCCAGGCAG
GGGCCTTAGAGTGAAGTTCAGCAGGAGCGCAGACGCCCCCGCGTACCAGCAGGGCCAGAACCAGC
TCTATAACGAGCTCAATCTAGGACGAAGAGAGGAGTACGATGTTTTGGACAAGAGACGTGGCCG
GGACCCTGAGATGGGGGGAAAGCCGCAGAGAAGGAAGAACCCTCAGGAAGGCCTGTACAATGAA
CTGCAGAAAGATAAGATGGCGGAGGCCTACAGTGAGATTGGGATGAAAGGCGAGCGCCGGAGGG
GCAAGGGGCACGATGGCCTTTACCAGGGTCTCAGTACAGCCACCAAGGACACCTACGACGCCCTT
CACATGCAGGCCCTGCCCCCTCGCGCCAGGGCCAAAAGGTCTGGCTCCGGTGAGGGCAGAGGAAG
TCTTCTAACATGCGGTGACGTGGAGGAGAATCCCGGCCCTATGCCACCTCCTCGCCTCCTCTTCTT
CCTCCTCTTCCTCACCCCCATGGAAGTCAGGCCCGAGGAACCTCTAGTGGTGAAGGTGGAAGAGG
GAGATAACGCTGTGCTGCAGTGCCTCAAGGGGACCTCAGATGGCCCCACTCAGCAGCTGACCTGG
TCTCGGGAGTCCCCGCTTAAACCCTTCTTAAAACTCAGCCTGGGGCTGCCAGGCCTGGGAATCCA
CATGAGGCCCCTGGCCATCTGGCTTTTCATCTTCAACGTCTCTCAACAGATGGGGGGCTTCTACC
TGTGCCAGCCGGGGCCCCCCTCTGAGAAGGCCTGGCAGCCTGGCTGGACAGTCAATGTGGAGGGC
AGCGGGGAGCTGTTCCGGTGGAATGTTTCGGACCTAGGTGGCCTGGGCTGTGGCCTGAAGAACAG
GTCCTCAGAGGGCCCCAGCTCCCCTTCCGGGAAGCTCATGAGCCCCAAGCTGTATGTGTGGGCCA
AAGACCGCCCTGAGATCTGGGAGGGAGAGCCTCCGTGTCTCCCACCGAGGGACAGCCTGAACCAG
AGCCTCAGCCAGGACCTCACCATGGCCCCTGGCTCCACACTCTGGCTGTCCTGTGGGGTACCCCCT
GACTCTGTGTCCAGGGGCCCCCTCTCCTGGACCCATGTGCACCCCAAGGGGCCTAAGTCATTGCT
GAGCCTAGAGCTGAAGGACGATCGCCCGGCCAGAGATATGTGGGTAATGGAGACGGGTCTGTTG
TTGCCCCGGGCCACAGCTCAAGACGCTGGAAAGTATTATTGTCACCGTGGCAACCTGACCATGTC
ATTCCACCTGGAGATCACTGCTCGGCCAGTACTATGGCACTGGCTGCTGAGGACTGGTGGCTGGA
AGGTCTCAGCTGTGACTTTGGCTTATCTGATCTTCTGCCTGTGTTCCCTTGTGGGCATTCTTCAT
CTTCAAAGAGCCCTGGTCCTGAGGAGGAAAAGAAAGCGAATGACTTAA

LS-NbMMRm5.38-CD28H-CD28TM-DAP10CS-CD3zICS-T2A-trCD19
(SEQ ID NO: 191) Protein sequence:
MEWTWVFLFLLSVTAGVHSQVQLQESGGGLVQAGGSLRLSCAASGFTDDDYDIGWFRQAPGKER
EGVS*CISSSDGST*YYADSVKGRFTISSDNAKNTVYLQMNSLKPEDTAVYYCAADFFRWDSGSYYVR
GCRHATYDYWGQGTQVTVSSVKGKHLCPSPLFPGPSKPFWVLVVVGGVLACYSLLVTVAFIIFWV
LCARPRRSPAQEDGKVYINMPGRGLRVKFSRSADAPAYQQGQNQLYNELNLGRREEYDVLDKRR
GRDPEMGGKPQRRKNPQEGLYNELQKDKMAEAYSEIGMKGERRRGKGHDGLYQGLSTATKDTY
DALHMQALPPRARAKRSGSGEGRGSLLTCGDVEENPGPMPPPRLLFFLLFLTPMEVRPEEPLVVK
VEEGDNAVLQCLKGTSDGPTQQLTWSRESPLKPFLKLSLGLPGLGIHMRPLAIWLFIFNVSQQMG
GFYLCQPGPPSEKAWQPGWTVNVEGSGELFRWNVSDLGGLGCGLKNRSSEGPSSPSGKLMSPKLY
VWAKDRPEIWEGEPPCLPPRDSLNQSLSQDLTMAPGSTLWLSCGVPPDSVSRGPLSWTHVHPKG
PKSLLSLELKDDRPARDMWVMETGLLLPRATAQDAGKYYCHRGNLTMSFHLEITARPVLWHWL
LRTGGWKVSAVTLAYLIFCLCSLVGILHLQRALVLR RKRKRMT (SEQ ID NO: 291) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAAGCTGGCGGAAGCCTGAGACTGTCTTGTGCCGCTT
CTGGCTTCACCGACGACGACTACGATATCGGCTGGTTCAGACAGGCCCCTGGCAAAGAGAGAGAG
GGCGTCAGCTGTATCAGCAGCTCTGACGGCTCTACCTACTACGCCGACAGCGTGAAGGGCAGATT
CACCATCAGCAGCGACAACGCCAAGAACACCGTGTACCTGCAGATGAACTCTCTGAAGCCCGAGG
ACACCGCCGTGTACTACTGTGCCGCCGACTTCTTCAGATGGGACAGCGGCAGCTACTACGTGCGG
GGATGTAGACACGCCACCTACGATTACTGGGGCCAGGGCACACAAGTGACCGTGTCATCTGTGAA
AGGGAAACACCTTTGTCCAAGTCCCCTATTTCCCGGACCTTCTAAGCCCTTTTGGGTGCTGGTGG
TGGTTGGTGGAGTCCTGGCTTGCTATAGCTTGCTAGTAACAGTGGCCTTTATTATTTTCTGGGTG
CTGTGCGCACGCCCACGCCGCAGCCCCGCCCAAGAAGATGGCAAAGTCTACATCAACATGCCAGG
CAGGGGCCTTAGAGTGAAGTTCAGCAGGAGCGCAGACGCCCCCGCGTACCAGCAGGGCCAGAACC
AGCTCTATAACGAGCTCAATCTAGGACGAAGAGAGGAGTACGATGTTTTGGACAAGAGACGTGG
CCGGGACCCTGAGATGGGGGGAAAGCCGCAGAGAAGGAAGAACCCTCAGGAAGGCCTGTACAAT
GAACTGCAGAAAGATAAGATGGCGGAGGCCTACAGTGAGATTGGGATGAAAGGCGAGCGCCGGA
GGGGCAAGGGGCACGATGGCCTTTACCAGGGTCTCAGTACAGCCACCAAGGACACCTACGACGCC
CTTCACATGCAGGCCCTGCCCCCTCGCGCCAGGGCCAAAAGGTCTGGCTCCGGTGAGGGCAGAGG
AAGTCTTCTAACATGCGGTGACGTGGAGGAGAATCCCGGCCCTATGCCACCTCCTCGCCTCCTCT
TCTTCCTCCTCTTCCTCACCCCCATGGAAGTCAGGCCCGAGGAACCTCTAGTGGTGAAGGTGGAA
GAGGGAGATAACGCTGTGCTGCAGTGCCTCAAGGGGACCTCAGATGGCCCCACTCAGCAGCTGAC
CTGGTCTCGGGAGTCCCCGCTTAAACCCTTCTTAAAACTCAGCCTGGGGCTGCCAGGCCTGGGAA
TCCACATGAGGCCCCTGGCCATCTGGCTTTTCATCTTCAACGTCTCTCAACAGATGGGGGGCTTC
TACCTGTGCCAGCCGGGGCCCCCCTCTGAGAAGGCCTGGCAGCCTGGCTGGACAGTCAATGTGGA
GGGCAGCGGGGAGCTGTTCCGGTGGAATGTTTCGGACCTAGGTGGCCTGGGCTGTGGCCTGAAGA
ACAGGTCCTCAGAGGGCCCCAGCTCCCCTTCCGGGAAGCTCATGAGCCCCAAGCTGTATGTGTGG
GCCAAAGACCGCCCTGAGATCTGGGAGGGAGAGCCTCCGTGTCTCCCACCGAGGGACAGCCTGAA
CCAGAGCCTCAGCCAGGACCTCACCATGGCCCCTGGCTCCACACTCTGGCTGTCCTGTGGGGTACC
CCCTGACTCTGTGTCCAGGGGCCCCCTCTCCTGGACCCATGTGCACCCCAAGGGGCCTAAGTCATT
GCTGAGCCTAGAGCTGAAGGACGATCGCCCGGCCAGAGATATGTGGGTAATGGAGACGGGTCTG
TTGTTGCCCCGGGCCACAGCTCAAGACGCTGGAAAGTATTATTGTCACCGTGGCAACCTGACCAT
GTCATTCCACCTGGAGATCACTGCTCGGCCAGTACTATGGCACTGGCTGCTGAGGACTGGTGGCT
GGAAGGTCTCAGCTGTGACTTTGGCTTATCTGATCTTCTGCCTGTGTTCCCTTGTGGGCATTCTT
CATCTTCAAAGAGCCCTGGTCCTGAGGAGGAAAAGAAAGCGAATGACTTAA

AMINO ACID AND NUCLEIC ACID SEQUENCES

LS-scFvP4A8VHVL-CD28H-CD28TM-DAP10CS-CD3zICS-T2A-trCD19
(SEQ ID NO: 192) Protein sequence:
MEWTWVFLFLLSVTAGVHSQVQLQQSGPEVVRPGVSVKISCKGSGYTFTDYGMHWVKQSHAKSL
EWIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRASKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVLCARPRRSPAQEDGKVYI
NMPGRGLRVKFSRSADAPAYQQGQNQLYNELNLGRREEYDVLDKRRGRDPEMGGKPQRRKNPQ
EGLYNELQKDKMAEAYSEIGMKGERRRGKGHDGLYQGLSTATKDTYDALHMQALPPRARAKRSG
SGEGRGSLLTCGDVEENPGPMPPPRLLFFLLFLTPMEVRPEEPLVVKVEEGDNAVLQCLKGTSDGP
TQQLTWSRESPLKPFLKLSLGLPGLGIHMRPLAIWLFIFNVSQQMGGFYLCQPGPPSEKAWQPGW
TVNVEGSGELFRWNVSDLGGLGCGLKNRSSEGPSSPSGKLMSPKLYVWAKDRPEIWEGEPPCLPP
RDSLNQSLSQDLTMAPGSTLWLSCGVPPDSVSRGPLSWTHVHPKGPKSLLSLELKDDRPARDMW
VMETGLLLPRATAQDAGKYYCHRGNLTMSFHLEITARPVLWHWLLRTGGWKVSAVTLAYLIFCL
CSLVGILHLQRALVLR RKRKRMT (SEQ ID NO: 292) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATGCACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAGCAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGCTGTGCGCACGCCCACGCCGCAGCCCCGCCCAAGAAGATG
GCAAAGTCTACATCAACATGCCAGGCAGGGGCCTTAGAGTGAAGTTCAGCAGGAGCGCAGACGCC
CCCGCGTACCAGCAGGGCCAGAACCAGCTCTATAACGAGCTCAATCTAGGACGAAGAGAGGAGTA
CGATGTTTTGGACAAGAGACGTGGCCGGGACCCTGAGATGGGGGGAAAGCCGCAGAGAAGGAAG
AACCCTCAGGAAGGCCTGTACAATGAACTGCAGAAAGATAAGATGGCGGAGGCCTACAGTGAGA
TTGGGATGAAAGGCGAGCGCCGGAGGGGCAAGGGGCACGATGGCCTTTACCAGGGTCTCAGTAC
AGCCACCAAGGACACCTACGACGCCCTTCACATGCAGGCCCTGCCCCCTCGCGCCAGGGCCAAAA
GGTCTGGCTCCGGTGAGGGCAGAGGAAGTCTTCTAACATGCGGTGACGTGGAGGAGAATCCCGGC
CCTATGCCACCTCCTCGCCTCCTCTTCTTCCTCCTCTTCCTCACCCCCATGGAAGTCAGGCCCGAG
GAACCTCTAGTGGTGAAGGTGGAAGAGGGAGATAACGCTGTGCTGCAGTGCCTCAAGGGGACCT
CAGATGGCCCCACTCAGCAGCTGACCTGGTCTCGGGAGTCCCCGCTTAAACCCTTCTTAAAACTC
AGCCTGGGGCTGCCAGGCCTGGGAATCCACATGAGGCCCCTGGCCATCTGGCTTTTCATCTTCAA
CGTCTCTCAACAGATGGGGGGCTTCTACCTGTGCCAGCCGGGGCCCCCCTCTGAGAAGGCCTGGC
AGCCTGGCTGGACAGTCAATGTGGAGGGCAGCGGGGAGCTGTTCCGGTGGAATGTTTCGGACCTA
GGTGGCCTGGGCTGTGGCCTGAAGAACAGGTCCTCAGAGGGCCCCAGCTCCCCTTCCGGGAAGCT
CATGAGCCCCAAGCTGTATGTGTGGGCCAAAGACCGCCCTGAGATCTGGGAGGGAGAGCCTCCGT
GTCTCCCACCGAGGGACAGCCTGAACCAGAGCCTCAGCCAGGACCTCACCATGGCCCCTGGCTCCA
CACTCTGGCTGTCCTGTGGGGTACCCCCTGACTCTGTGTCCAGGGGCCCCCTCTCCTGGACCCATG
TGCACCCCAAGGGGCCTAAGTCATTGCTGAGCCTAGAGCTGAAGGACGATCGCCCGGCCAGAGAT
ATGTGGGTAATGGAGACGGGTCTGTTGTTGCCCCGGGCCACAGCTCAAGACGCTGGAAAGTATTA
TTGTCACCGTGGCAACCTGACCATGTCATTCCACCTGGAGATCACTGCTCGGCCAGTACTATGGC
ACTGGCTGCTGAGGACTGGTGGCTGGAAGGTCTCAGCTGTGACTTTGGCTTATCTGATCTTCTGC
CTGTGTTCCCTTGTGGGCATTCTTCATCTTCAAAGAGCCCTGGTCCTGAGGAGGAAAAGAAAGCG
AATGACTTAA LS-scFvP4A8VLVH-CD28H-CD28TM-DAP10CS-CD3zICS-T2A-trCD19
(SEQ ID NO: 193) Protein sequence:
MEWTWVFLFLLSVTAGVHSDIVLTQSPASLAVSLGQRATISCRASKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGMHWVKQSHAKSLEWIG*VISTY
NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVLCARPRRSPAQEDGKVYIN
MPGRGLRVKFSRSADAPAYQQGQNQLYNELNLGRREEYDVLDKRRGRDPEMGGKPQRRKNPQE
GLYNELQKDKMAEAYSEIGMKGERRRGKGHDGLYQGLSTATKDTYDALHMQALPPRARAKRSGS
GEGRGSLLTCGDVEENPGPMPPPRLLFFLLFLTPMEVRPEEPLVVKVEEGDNAVLQCLKGTSDGP
TQQLTWSRESPLKPFLKLSLGLPGLGIHMRPLAIWLFIFNVSQQMGGFYLCQPGPPSEKAWQPGW
TVNVEGSGELFRWNVSDLGGLGCGLKNRSSEGPSSPSGKLMSPKLYVWAKDRPEIWEGEPPCLPP
RDSLNQSLSQDLTMAPGSTLWLSCGVPPDSVSRGPLSWTHVHPKGPKSLLSLELKDDRPARDMW
VMETGLLLPRATAQDAGKYYCHRGNLTMSFHLEITARPVLWHWLLRTGGWKVSAVTLAYLIFCL
CSLVGILHLQRALVLR RKRKRMT (SEQ ID NO: 293) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAGCAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC APPENDIX-continued

AMINO ACID AND NUCLEIC ACID SEQUENCES

TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATGCACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGCTGTGCGCACGCCCACGCCGCAGCCCCGCCCAAGAAGA
TGGCAAAGTCTACATCAACATGCCAGGCAGGGGCCTTAGAGTGAAGTTCAGCAGGAGCGCAGAC
GCCCCCGCGTACCAGCAGGGCCAGAACCAGCTCTATAACGAGCTCAATCTAGGACGAAGAGAGGA
GTACGATGTTTTGGACAAGAGACGTGGCCGGGACCCTGAGATGGGGGGAAAGCCGCAGAGAAGG
AAGAACCCTCAGGAAGGCCTGTACAATGAACTGCAGAAAGATAAGATGGCGGAGGCCTACAGTG
AGATTGGGATGAAAGGCGAGCGCCGGAGGGGCAAGGGGCACGATGGCCTTTACCAGGGTCTCAG
TACAGCCACCAAGGACACCTACGACGCCCTTCACATGCAGGCCCTGCCCCCTCGCGCCAGGGCCAA
AAGGTCTGGCTCCGGTGAGGGCAGAGGAAGTCTTCTAACATGCGGTGACGTGGAGGAGAATCCC
GGCCCTATGCCACCTCCTCGCCTCCTCTTCTTCCTCCTCTTCCTCACCCCCATGGAAGTCAGGCCC
GAGGAACCTCTAGTGGTGAAGGTGGAAGAGGGAGATAACGCTGTGCTGCAGTGCCTCAAGGGGA
CCTCAGATGGCCCCACTCAGCAGCTGACCTGGTCTCGGGAGTCCCCGCTTAAACCCTTCTTAAAA
CTCAGCCTGGGGCTGCCAGGCCTGGGAATCCACATGAGGCCCCTGGCCATCTGGCTTTTCATCTT
CAACGTCTCTCAACAGATGGGGGGCTTCTACCTGTGCCAGCCGGGGCCCCCCTCTGAGAAGGCCT
GGCAGCCTGGCTGGACAGTCAATGTGGAGGGCAGCGGGGAGCTGTTCCGGTGGAATGTTTCGGAC
CTAGGTGGCCTGGGCTGTGGCCTGAAGAACAGGTCCTCAGAGGGCCCCAGCTCCCCTTCCGGGAA
GCTCATGAGCCCCAAGCTGTATGTGTGGGCCAAAGACCGCCCTGAGATCTGGGAGGGAGAGCCTC
CGTGTCTCCCACCGAGGGACAGCCTGAACCAGAGCCTCAGCCAGGACCTCACCATGGCCCCTGGC
TCCACACTCTGGCTGTCCTGTGGGGTACCCCCTGACTCTGTGTCCAGGGGCCCCCTCTCCTGGACC
CATGTGCACCCCAAGGGGCCTAAGTCATTGCTGAGCCTAGAGCTGAAGGACGATCGCCCGGCCAG
AGATATGTGGGTAATGGAGACGGGTCTGTTGTTGCCCCGGGCCACAGCTCAAGACGCTGGAAAG
TATTATTGTCACCGTGGCAACCTGACCATGTCATTCCACCTGGAGATCACTGCTCGGCCAGTACT
ATGGCACTGGCTGCTGAGGACTGGTGGCTGGAAGGTCTCAGCTGTGACTTTGGCTTATCTGATCT
TCTGCCTGTGTTCCCTTGTGGGCATTCTTCATCTTCAAAGAGCCCTGGTCCTGAGGAGGAAAAGA
AAGCGAATGACTTAA

LS-scFvP3GSVHVL-CD28H-CD28TM-DAP10CS-CD3zICS-T2A-trCD19
(SEQ ID NO: 194) Protein sequence:
MEWTWVFLFLLSVTAGVHSQVQLQQSGPEVVRPGVSVKISCKGSGYTFTDYGIHWVKQSHAKSLE
WIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRANKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVLCARPRRSPAQEDGKVYI
NMPGRGLRVKFSRSADAPAYQQGQNQLYNELNLGRREEYDVLDKRRGRDPEMGGKPQRRKNPQ
EGLYNELQKDKMAEAYSEIGMKGERRRGKGHDGLYQGLSTATKDTYDALHMQALPPRARAKRSG
SGEGRGSLLTCGDVEENPGPMPPPRLLFFLLFLTPMEVRPEEPLVVKVEEGDNAVLQCLKGTSDGP
TQQLTWSRESPLKPFLKLSLGLPGLGIHMRPLAIWLFIFNVSQQMGGFYLCQPGPPSEKAWQPGW
TVNVEGSGELFRWNVSDLGGLGCGLKNRSSEGPSSPSGKLMSPKLYVWAKDRPEIWEGEPPCLPP
RDSLNQSLSQDLTMAPGSTLWLSCGVPPDSVSRGPLSWTHVHPKGPKSLLSLELKDDRPARDMW
VMETGLLLPRATAQDAGKYYCHRGNLTMSFHLEITARPVLWHWLLRTGGWKVSAVTLAYLIFCL
CSLVGILHLQRALVLR RKRKRMT (SEQ ID NO: 294) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATACACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAACAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGCTGTGCGCACGCCCACGCCGCAGCCCCGCCCAAGAAGATG
GCAAAGTCTACATCAACATGCCAGGCAGGGGCCTTAGAGTGAAGTTCAGCAGGAGCGCAGACGCC
CCCGCGTACCAGCAGGGCCAGAACCAGCTCTATAACGAGCTCAATCTAGGACGAAGAGAGGAGTA
CGATGTTTTGGACAAGAGACGTGGCCGGGACCCTGAGATGGGGGGAAAGCCGCAGAGAAGGAAG
AACCCTCAGGAAGGCCTGTACAATGAACTGCAGAAAGATAAGATGGCGGAGGCCTACAGTGAGA
TTGGGATGAAAGGCGAGCGCCGGAGGGGCAAGGGGCACGATGGCCTTTACCAGGGTCTCAGTAC
AGCCACCAAGGACACCTACGACGCCCTTCACATGCAGGCCCTGCCCCCTCGCGCCAGGGCCAAAA
GGTCTGGCTCCGGTGAGGGCAGAGGAAGTCTTCTAACATGCGGTGACGTGGAGGAGAATCCCGGC
CCTATGCCACCTCCTCGCCTCCTCTTCTTCCTCCTCTTCCTCACCCCCATGGAAGTCAGGCCCGAG
GAACCTCTAGTGGTGAAGGTGGAAGAGGGAGATAACGCTGTGCTGCAGTGCCTCAAGGGGACCT
CAGATGGCCCCACTCAGCAGCTGACCTGGTCTCGGGAGTCCCCGCTTAAACCCTTCTTAAAACTC
AGCCTGGGGCTGCCAGGCCTGGGAATCCACATGAGGCCCCTGGCCATCTGGCTTTTCATCTTCAA
CGTCTCTCAACAGATGGGGGGCTTCTACCTGTGCCAGCCGGGGCCCCCCTCTGAGAAGGCCTGGC

AMINO ACID AND NUCLEIC ACID SEQUENCES

AGCCTGGCTGGACAGTCAATGTGGAGGGCAGCGGGGAGCTGTTCCGGTGGAATGTTTCGGACCTA
GGTGGCCTGGGCTGTGGCCTGAAGAACAGGTCCTCAGAGGGCCCCAGCTCCCCTTCCGGGAAGCT
CATGAGCCCCAAGCTGTATGTGTGGGCCAAAGACCGCCCTGAGATCTGGGAGGGAGAGCCTCCGT
GTCTCCCACCGAGGGACAGCCTGAACCAGAGCCTCAGCCAGGACCTCACCATGGCCCCTGGCTCCA
CACTCTGGCTGTCCTGTGGGGTACCCCCTGACTCTGTGTCCAGGGGCCCCCTCTCCTGGACCCATG
TGCACCCCAAGGGGCCTAAGTCATTGCTGAGCCTAGAGCTGAAGGACGATCGCCCGGCCAGAGAT
ATGTGGGTAATGGAGACGGGTCTGTTGTTGCCCCGGGCCACAGCTCAAGACGCTGGAAAGTATTA
TTGTCACCGTGGCAACCTGACCATGTCATTCCACCTGGAGATCACTGCTCGGCCAGTACTATGGC
ACTGGCTGCTGAGGACTGGTGGCTGGAAGGTCTCAGCTGTGACTTTGGCTTATCTGATCTTCTGC
CTGTGTTCCCTTGTGGGCATTCTTCATCTTCAAAGAGCCCTGGTCCTGAGGAGGAAAAGAAAGCG
AATGACTTAA

LS-scFvP3G5VLVH-CD28H-CD28TM-DAP10CS-CD3zICS-T2A-trCD19
(SEQ ID NO: 195) Protein sequence:
MEWTWVFLFLLSVTAGVHSDIVLTQSPASLAVSLGQRATISCRANKSVSTSSYSYMHWYQQKPGQ
PPKLLIKYASNLESGVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGIHWVKQSHAKSLEWIGVISTY
NGYTNYNQKFKGKATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVLCARPRRSPAQEDGKVYIN
MPGRGLRVKFSRSADAPAYQQGQNQLYNELNLGRREEYDVLDKRRGRDPEMGGKPQRRKNPQE
GLYNELQKDKMAEAYSEIGMKGERRRGKGHDGLYQGLSTATKDTYDALHMQALPPRARAKRSGS
GEGRGSLLTCGDVEENPGPMPPPRLLFFLLFLTPMEVRPEEPLVVKVEEGDNAVLQCLKGTSDGP
TQQLTWSRESPLKPFLKLSLGLPGLGIHMRPLAIWLFIFNVSQQMGGFYLCQPGPPSEKAWQPGW
TVNVEGSGELFRWNVSDLGGLGCGLKNRSSEGPSSPSGKLMSPKLYVWAKDRPEIWEGEPPCLPP
RDSLNQSLSQDLTMAPGSTLWLSCGVPPDSVSRGPLSWTHVHPKGPKSLLSLELKDDRPARDMW
VMETGLLLPRATAQDAGKYYCHRGNLTMSFHLEITARPVLWHWLLRTGGWKVSAVTLAYLIFCL
CSLVGILHLQRALVLR RKRKRMT (SEQ ID NO: 295) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAACAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATACACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGCTGTGCGCACGCCCACGCCGCAGCCCCGCCCAAGAAGA
TGGCAAAGTCTACATCAACATGCCAGGCAGGGGCCTTAGAGTGAAGTTCAGCAGGAGCGCAGAC
GCCCCCGCGTACCAGCAGGGCCAGAACCAGCTCTATAACGAGCTCAATCTAGGACGAAGAGAGGA
GTACGATGTTTTGGACAAGAGACGTGGCCGGGACCCTGAGATGGGGGGAAAGCCGCAGAGAAGG
AAGAACCCTCAGGAAGGCCTGTACAATGAACTGCAGAAAGATAAGATGGCGGAGGCCTACAGTG
AGATTGGGATGAAAGGCGAGCGCCGGAGGGGCAAGGGGCACGATGGCCTTTACCAGGGTCTCAG
TACAGCCACCAAGGACACCTACGACGCCCTTCACATGCAGGCCCTGCCCCCTCGCGCCAGGGCCAA
AAGGTCTGGCTCCGGTGAGGGCAGAGGAAGTCTTCTAACATGCGGTGACGTGGAGGAGAATCCC
GGCCCTATGCCACCTCCTCGCCTCCTCTTCTTCCTCCTCTTCCTCACCCCCATGGAAGTCAGGCCC
GAGGAACCTCTAGTGGTGAAGGTGGAAGAGGGAGATAACGCTGTGCTGCAGTGCCTCAAGGGGA
CCTCAGATGGCCCCACTCAGCAGCTGACCTGGTCTCGGGAGTCCCCGCTTAAACCCTTCTTAAAA
CTCAGCCTGGGGCTGCCAGGCCTGGGAATCCACATGAGGCCCCTGGCCATCTGGCTTTTCATCTT
CAACGTCTCTCAACAGATGGGGGGCTTCTACCTGTGCCAGCCGGGGCCCCCCTCTGAGAAGGCCT
GGCAGCCTGGCTGGACAGTCAATGTGGAGGGCAGCGGGGAGCTGTTCCGGTGGAATGTTTCGGAC
CTAGGTGGCCTGGGCTGTGGCCTGAAGAACAGGTCCTCAGAGGGCCCCAGCTCCCCTTCCGGGAA
GCTCATGAGCCCCAAGCTGTATGTGTGGGCCAAAGACCGCCCTGAGATCTGGGAGGGAGAGCCTC
CGTGTCTCCCACCGAGGGACAGCCTGAACCAGAGCCTCAGCCAGGACCTCACCATGGCCCCTGGC
TCCACACTCTGGCTGTCCTGTGGGGTACCCCCTGACTCTGTGTCCAGGGGCCCCCTCTCCTGGACC
CATGTGCACCCCAAGGGGCCTAAGTCATTGCTGAGCCTAGAGCTGAAGGACGATCGCCCGGCCAG
AGATATGTGGGTAATGGAGACGGGTCTGTTGTTGCCCCGGGCCACAGCTCAAGACGCTGGAAAG
TATTATTGTCACCGTGGCAACCTGACCATGTCATTCCACCTGGAGATCACTGCTCGGCCAGTACT
ATGGCACTGGCTGCTGAGGACTGGTGGCTGGAAGGTCTCAGCTGTGACTTTGGCTTATCTGATCT
TCTGCCTGTGTTCCCTTGTGGGCATTCTTCATCTTCAAAGAGCCCTGGTCCTGAGGAGGAAAAGA
AAGCGAATGACTTAA CD3zICS-DAP10CS-TWEAK-T2A-trCD19
(SEQ ID NO: 198) Protein sequence:
LRVKFSRSADAPAYQQGQNQLYNELNLGRREEYDVLDKRRGRDPEMGGKPQRRKNPQEGLYNEL
QKDKMAEAYSEIGMKGERRRGKGHDGLYQGLSTATKDTYDALHMQALPPRLCARPRRSPAQEDG
KVYINMPGRGAARRSQRRRGRRGEPGTALLVPLALGLGLALACLGLLLAVVSLGSRASLSAQEPAQ
EELVAEEDQDPSELNPQTEESQDPAPFLNRLVRPRRSAPKGRKTRARRAIAAHYEVHPRPGQDGA
QAGVDGTVSGWEEARINSSSPLRYNRQIGEFIVTRAGLYYLYCQVHFDEGKAVYLKLDLLVDGVLA
LRCLEEFSATAASSLGPQLRLCQVSGLLALRPGSSLRIRTLPWAHLKAAPFLTYFGLFQVHARAKRS
GSGEGRGSLLTCGDVEENPGPMPPPRLLFFLLFLTPMEVRPEEPLVVKVEEGDNAVLQCLKGTSD
GPTQQLTWSRESPLKPFLKLSLGLPGLGIHMRPLAIWLFIFNVSQQMGGFYLCQPGPPSEKAWQP APPENDIX-continued

AMINO ACID AND NUCLEIC ACID SEQUENCES

GWTVNVEGSGELFRWNVSDLGGLGCGLKNRSSEGPSSPSGKLMSPKLYVWAKDRPEIWEGEPPC
LPPRDSLNQSLSQDLTMAPGSTLWLSCGVPPDSVSRGPLSWTHVHPKGPKSLLSLELKDDRPARD
MWVMETGLLLPRATAQDAGKYYCHRGNLTMSFHLEITARPVLWHWLLRTGGWKVSAVTLAYLI
FCLCSLVGILHLQRALVLR RKRKRMT (SEQ ID NO: 298) DNA sequence:
CTTAGAGTGAAGTTCAGCAGGAGCGCAGACGCCCCCGCGTACCAGCAGGGCCAGAACCAGCTCTA
TAACGAGCTCAATCTAGGACGAAGAGAGGAGTACGATGTTTTGGACAAGAGACGTGGCCGGGAC
CCTGAGATGGGGGGAAAGCCGCAGAGAAGGAAGAACCCTCAGGAAGGCCTGTACAATGAACTGC
AGAAAGATAAGATGGCGGAGGCCTACAGTGAGATTGGGATGAAAGGCGAGCGCCGGAGGGGCAA
GGGGCACGATGGCCTTTACCAGGGTCTCAGTACAGCCACCAAGGACACCTACGACGCCCTTCACA
TGCAGGCCCTGCCCCCTCGCCTGTGCGCACGCCCACGCCGCAGCCCCGCCCAAGAAGATGGCAAAG
TCTACATCAACATGCCAGGCAGGGGCGCCGCCCGTCGGAGCCAGAGGCGGAGGGGGCGCCGGGGG
GAGCCGGGCACCGCCCTGCTGGTCCCGCTCGCGCTGGGCCTGGGCCTGGCGCTGGCCTGCCTCGGC
CTCCTGCTGGCCGTGGTCAGTTTGGGGAGCCGGGCATCGCTGTCCGCCCAGGAGCCTGCCCAGGA
GGAGCTGGTGGCAGAGGAGGACCAGGACCCGTCGGAACTGAATCCCCAGACAGAAGAAAGCCAG
GATCCTGCGCCTTTCCTGAACCGACTAGTTCGGCCTCGCAGAAGTGCACCTAAAGGCCGGAAAAC
ACGGGCTCGAAGAGCGATCGCAGCCCATTATGAAGTTCATCCACGACCTGGACAGGACGGAGCGC
AGGCAGGTGTGGACGGGACAGTGAGTGGCTGGGAGGAAGCCAGAATCAACAGCTCCAGCCCTCT
GCGCTACAACCGCCAGATCGGGGAGTTTATAGTCACCCGGGCTGGGCTCTACTACCTGTACTGTC
AGGTGCACTTTGATGAGGGGAAGGCTGTCTACCTGAAGCTGGACTTGCTGGTGGATGGTGTGCT
GGCCCTGCGCTGCCTGGAGGAATTCTCAGCCACTGCGGCCAGTTCCCTCGGGCCCCAGCTCCGCCT
CTGCCAGGTGTCTGGGCTGTTGGCCCTGCGGCCAGGGTCCTCCCTGCGGATCCGCACCCTCCCCTG
GGCCCATCTCAAGGCTGCCCCCTTCCTCACCTACTTCGGACTCTTCCAGGTTCACTGAGCCAGGGC
CAAAAGGTCTGGCTCCGGTGAGGGCAGAGGAAGTCTTCTAACATGCGGTGACGTGGAGGAGAAT
CCCGGCCCTATGCCACCTCCTCGCCTCCTCTTCTTCCTCCTCTTCCTCACCCCCATGGAAGTCAGG
CCCGAGGAACCTCTAGTGGTGAAGGTGGAAGAGGGAGATAACGCTGTGCTGCAGTGCCTCAAGG
GGACCTCAGATGGCCCCACTCAGCAGCTGACCTGGTCTCGGGAGTCCCCGCTTAAACCCTTCTTA
AAACTCAGCCTGGGGCTGCCAGGCCTGGGAATCCACATGAGGCCCCTGGCCATCTGGCTTTTCAT
CTTCAACGTCTCTCAACAGATGGGGGGCTTCTACCTGTGCCAGCCGGGGCCCCCCTCTGAGAAGG
CCTGGCAGCCTGGCTGGACAGTCAATGTGGAGGGCAGCGGGGAGCTGTTCCGGTGGAATGTTTCG
GACCTAGGTGGCCTGGGCTGTGGCCTGAAGAACAGGTCCTCAGAGGGCCCCAGCTCCCCTTCCGG
GAAGCTCATGAGCCCCAAGCTGTATGTGTGGGCCAAAGACCGCCCTGAGATCTGGGAGGGAGAGC
CTCCGTGTCTCCCACCGAGGGACAGCCTGAACCAGAGCCTCAGCCAGGACCTCACCATGGCCCCTG
GCTCCACACTCTGGCTGTCCTGTGGGGTACCCCCTGACTCTGTGTCCAGGGGCCCCCTCTCCTGGA
CCCATGTGCACCCCAAGGGGCCTAAGTCATTGCTGAGCCTAGAGCTGAAGGACGATCGCCCGGCC
AGAGATATGTGGGTAATGGAGACGGGTCTGTTGTTGCCCCGGGCCACAGCTCAAGACGCTGGAA
AGTATTATTGTCACCGTGGCAACCTGACCATGTCATTCCACCTGGAGATCACTGCTCGGCCAGTA
CTATGGCACTGGCTGCTGAGGACTGGTGGCTGGAAGGTCTCAGCTGTGACTTTGGCTTATCTGAT
CTTCTGCCTGTGTTCCCTTGTGGGCATTCTTCATCTTCAAAGAGCCCTGGTCCTGAGG
AGGAAAAGAAAGCGAATGACTTAA Full CAR sequences with the leader sequence (LS), suitable for use in humans
LS-NbMMRm22.84-CD28H-CD28TM-CD28CS-CD3zICS (SEQ ID NO: 578) Protein sequence:
MEWTWVFLFLLSVTAGVHSQVQLQESGGGLVQPGGSLRLSCAASGRTFSNYVNYAMGWFRQFPG
KEREFVA*SISWSSVTT*YYADSVKGRFTISRDNAKNTVYLQMNSLKPEDTAVYYCAAHLAQYSDYA
YRDPHQFGAWGQGTQVTVSSVKGKHLCPSPLFPGPSKPFWVLVVVGGVLACYSLLVTVAFIIFWV
SKRSRLLHSDYMNMTPRRPGPTRKHYQPYAPPRDFAAYRSLRVKFSRSADAPAYQQGQNQLYNE
LNLGRREEYDVLDKRRGRDPEMGGKPQRRKNPQEGLYNELQKDKMAEAYSEIGMKGERRRGKG
HDGLYQGLSTATKDTYDALHMQALPPR (SEQ ID NO: 678) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAACCTGGCGGAAGCCTGAGACTGTCTTGTGCCGCTT
CTGGCAGAACCTTCAGCAACTACGTGAACTACGCCATGGGCTGGTTCAGACAGTTCCCCGGCAAA
GAGAGAGAGTTCGTCGCCAGCATCAGCTGGTCTAGCGTGACCACCTACTACGCCGACAGCGTGAA
GGGCAGATTCACCATCAGCAGAGACAACGCCAAGAACACCGTGTACCTGCAGATGAACAGCCTGA
AGCCAGAGGACACCGCCGTGTACTACTGTGCTGCTCACCTGGCTCAGTACAGCGACTACGCCTAC
AGAGATCCCCACCAGTTTGGCGCTTGGGGCCAGGGAACACAAGTGACCGTTAGCTCTGTGAAAGG
GAAACACCTTTGTCCAAGTCCCCTATTTCCCGGACCTTCTAAGCCCTTTTGGGTGCTGGTGGTGG
TTGGTGGAGTCCTGGCTTGCTATAGCTTGCTAGTAACAGTGGCCTTTATTATTTTCTGGGTGAGG
AGTAAGAGGAGCAGGCTCCTGCACAGTGACTACATGAACATGACTCCCCGCCGCCCCGGGCCCAC
CCGCAAGCATTACCAGCCCTATGCCCCACCACGCGACTTCGCAGCCTATCGCTCCCTTAGAGTGAA
GTTCAGCAGGAGCGCAGACGCCCCCGCGTACCAGCAGGGCCAGAACCAGCTCTATAACGAGCTCA
ATCTAGGACGAAGAGAGGAGTACGATGTTTTGGACAAGAGACGTGGCCGGGACCCTGAGATGGG
GGGAAAGCCGCAGAGAAGGAAGAACCCTCAGGAAGGCCTGTACAATGAACTGCAGAAAGATAAG
ATGGCGGAGGCCTACAGTGAGATTGGGATGAAAGGCGAGCGCCGGAGGGGCAAGGGGCACGATG
GCCTTTACCAGGGTCTCAGTACAGCCACCAAGGACACCTACGACGCCCTTCACATGCAGGCCCTG
CCCCCTCGC LS-NbMMRm5.38-CD28H-CD28TM- CD28CS-CD3zICS
(SEQ ID NO: 579) Protein sequence:
MEWTWVFLFLLSVTAGVHSQVQLQESGGGLVQAGGSLRLSCAASGFTDDDYDIGWFRQAPGKER
EGVS*CISSSDGST*YYADSVKGRFTISSDNAKNTVYLQMNSLKPEDTAVYYCAADFFRWDSGSYYVR
GCRHATYDYWGQGTQVTVSSVKGKHLCPSPLFPGPSKPFWVLVVVGGVLACYSLLVTVAFIIFWV
SKRSRLLHSDYMNMTPRRPGPTRKHYQPYAPPRDFAAYRSLRVKFSRSADAPAYQQGQNQLYNE APPENDIX-continued

AMINO ACID AND NUCLEIC ACID SEQUENCES

LNLGRREEYDVLDKRRGRDPEMGGKPQRRKNPQEGLYNELQKDKMAEAYSEIGMKGERRRGKG
HDGLYQGLSTATKDTYDALHMQALPPR (SEQ ID NO: 579) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAAGCTGGCGGAAGCCTGAGACTGTCTTGTGCCGCTT
CTGGCTTCACCGACGACGACTACGATATCGGCTGGTTCAGACAGGCCCCTGGCAAAGAGAGAGAG
GGCGTCAGCTGTATCAGCAGCTCTGACGGCTCTACCTACTACGCCGACAGCGTGAAGGGCAGATT
CACCATCAGCAGCGACAACGCCAAGAACACCGTGTACCTGCAGATGAACTCTCTGAAGCCCGAGG
ACACCGCCGTGTACTACTGTGCCGCCGACTTCTTCAGATGGGACAGCGGCAGCTACTACGTGCGG
GGATGTAGACACGCCACCTACGATTACTGGGGCCAGGGCACACAAGTGACCGTGTCATCTGTGAA
AGGGAAACACCTTTGTCCAAGTCCCCTATTTCCCGGACCTTCTAAGCCCTTTTGGGTGCTGGTGG
TGGTTGGTGGAGTCCTGGCTTGCTATAGCTTGCTAGTAACAGTGGCCTTTATTATTTTCTGGGTG
AGGAGTAAGAGGAGCAGGCTCCTGCACAGTGACTACATGAACATGACTCCCCGCCGCCCCGGGCC
CACCCGCAAGCATTACCAGCCCTATGCCCCACCACGCGACTTCGCAGCCTATCGCTCCCTTAGAGT
GAAGTTCAGCAGGAGCGCAGACGCCCCCGCGTACCAGCAGGGCCAGAACCAGCTCTATAACGAGC
TCAATCTAGGACGAAGAGAGGAGTACGATGTTTTGGACAAGAGACGTGGCCGGGACCCTGAGAT
GGGGGGAAAGCCGCAGAGAAGGAAGAACCCTCAGGAAGGCCTGTACAATGAACTGCAGAAAGAT
AAGATGGCGGAGGCCTACAGTGAGATTGGGATGAAAGGCGAGCGCCGGAGGGGCAAGGGGCACG
ATGGCCTTTACCAGGGTCTCAGTACAGCCACCAAGGACACCTACGACGCCCTTCACATGCAGGCC
CTGCCCCCTCGC LS-scFvP4A8VHVL-CD28H-CD28TM-CD28CS-CD3zICS
(SEQ ID NO: 580) Protein sequence:
MEWTWVFLFLLSVTAGVHSQVQLQQSGPEVVRPGVSVKISCKGSGYTFTDYGMHWVKQSHAKSL
EWIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRASKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVSKRSRLLHSDYMNMTPR
RPGPTRKHYQPYAPPRDFAAYRSLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPR (SEQ ID NO: 680) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATGCACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAGCAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGAGGAGTAAGAGGAGCAGGCTCCTGCACAGTGACTACATG
AACATGACTCCCCGCCGCCCCGGGCCCACCCGCAAGCATTACCAGCCCTATGCCCCACCACGCGAC
TTCGCAGCCTATCGCTCCCTTAGAGTGAAGTTCAGCAGGAGCGCAGACGCCCCCGCGTACCAGCA
GGGCCAGAACCAGCTCTATAACGAGCTCAATCTAGGACGAAGAGAGGAGTACGATGTTTTGGAC
AAGAGACGTGGCCGGGACCCTGAGATGGGGGGAAAGCCGCAGAGAAGGAAGAACCCTCAGGAAG
GCCTGTACAATGAACTGCAGAAAGATAAGATGGCGGAGGCCTACAGTGAGATTGGGATGAAAGG
CGAGCGCCGGAGGGGCAAGGGGCACGATGGCCTTTACCAGGGTCTCAGTACAGCCACCAAGGACA
CCTACGACGCCCTTCACATGCAGGCCCTGCCCCCTCGC LS-scFvP4A8VLVH-CD28H-CD28TM-CD28CS-CD3zICS
(SEQ ID NO: 581) Protein sequence:
MEWTWVFLFLLSVTAGVHSDIVLTQSPASLAVSLGQRATISCRASKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGMHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVSKRSRLLHSDYMNMTPRR
PGPTRKHYQPYAPPRDFAAYRSLRVKFSRSADAPAYQQGQNQLYNELNLGRREEYDVLDKRRGR
DPEMGGKPQRRKNPQEGLYNELQKDKMAEAYSEIGMKGERRRGKGHDGLYQGLSTATKDTYDA
LHMQALPPR (SEQ ID NO: 681) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAGCAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATGCACTGGGTGAAGCAGAGTCATGCAAAGAGTCTAGAGTGGATTGGA APPENDIX-continued

AMINO ACID AND NUCLEIC ACID SEQUENCES

GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGAGGAGTAAGAGGAGCAGGCTCCTGCACAGTGACTACAT
GAACATGACTCCCCGCCGCCCCGGGCCCACCCGCAAGCATTACCAGCCCTATGCCCCACCACGCGA
CTTCGCAGCCTATCGCTCCCTTAGAGTGAAGTTCAGCAGGAGCGCAGACGCCCCCGCGTACCAGC
AGGGCCAGAACCAGCTCTATAACGAGCTCAATCTAGGACGAAGAGAGGAGTACGATGTTTTGGA
CAAGAGACGTGGCCGGGACCCTGAGATGGGGGGAAAGCCGCAGAGAAGGAAGAACCCTCAGGAA
GGCCTGTACAATGAACTGCAGAAAGATAAGATGGCGGAGGCCTACAGTGAGATTGGGATGAAAG
GCGAGCGCCGGAGGGGCAAGGGGCACGATGGCCTTTACCAGGGTCTCAGTACAGCCACCAAGGAC
ACCTACGACGCCCTTCACATGCAGGCCCTGCCCCCTCGC

LS-scFvP3G5VHVL-CD28H-CD28TM-CD28CS-CD3zICS
(SEQ ID NO: 582) Protein sequence:
MEWTWVFLFLLSVTAGVHSQVQLQQSGPEVVRPGVSVKISCKGSGYTFTDYGIHWVKQSHAKSLE
WIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRANKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVSKRSRLLHSDYMNMTPR
RPGPTRKHYQPYAPPRDFAAYRSLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPR (SEQ ID NO: 682) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATACACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAACAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGAGGAGTAAGAGGAGCAGGCTCCTGCACAGTGACTACATG
AACATGACTCCCCGCCGCCCCGGGCCCACCCGCAAGCATTACCAGCCCTATGCCCCACCACGCGAC
TTCGCAGCCTATCGCTCCCTTAGAGTGAAGTTCAGCAGGAGCGCAGACGCCCCCGCGTACCAGCA
GGGCCAGAACCAGCTCTATAACGAGCTCAATCTAGGACGAAGAGAGGAGTACGATGTTTTGGAC
AAGAGACGTGGCCGGGACCCTGAGATGGGGGGAAAGCCGCAGAGAAGGAAGAACCCTCAGGAAG
GCCTGTACAATGAACTGCAGAAAGATAAGATGGCGGAGGCCTACAGTGAGATTGGGATGAAAGG
CGAGCGCCGGAGGGGCAAGGGGCACGATGGCCTTTACCAGGGTCTCAGTACAGCCACCAAGGACA
CCTACGACGCCCTTCACATGCAGGCCCTGCCCCCTCGC LS-scFvP3G5VLVH-CD28H-CD28TM-CD28CS-CD3zICS
(SEQ ID NO: 583) Protein sequence:
MEWTWVFLFLLSVTAGVHSDIVLTQSPASLAVSLGQRATISCRANKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGIHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVSKRSRLLHSDYMNMTPRR
PGPTRKHYQPYAPPRDFAAYRSLRVKFSRSADAPAYQQGQNQLYNELNLGRREEYDVLDKRRGR
DPEMGGKPQRRKNPQEGLYNELQKDKMAEAYSEIGMKGERRRGKGHDGLYQGLSTATKDTYDA
LHMQALPPR (SEQ ID NO: 683) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAACAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATACACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGAGGAGTAAGAGGAGCAGGCTCCTGCACAGTGACTACAT
GAACATGACTCCCCGCCGCCCCGGGCCCACCCGCAAGCATTACCAGCCCTATGCCCCACCACGCGA
CTTCGCAGCCTATCGCTCCCTTAGAGTGAAGTTCAGCAGGAGCGCAGACGCCCCCGCGTACCAGC APPENDIX-continued

AMINO ACID AND NUCLEIC ACID SEQUENCES

AGGGCCAGAACCAGCTCTATAACGAGCTCAATCTAGGACGAAGAGAGGAGTACGATGTTTTGGA
CAAGAGACGTGGCCGGGACCCTGAGATGGGGGGAAAGCCGCAGAGAAGGAAGAACCCTCAGGAA
GGCCTGTACAATGAACTGCAGAAAGATAAGATGGCGGAGGCCTACAGTGAGATTGGGATGAAAG
GCGAGCGCCGGAGGGGCAAGGGGCACGATGGCCTTTACCAGGGTCTCAGTACAGCCACCAAGGAC
ACCTACGACGCCCTTCACATGCAGGCCCTGCCCCCTCGC

LS-NbMMRm22.84-CD28H-CD28TM-41BBCS-CD3zICS
(SEQ ID NO: 584) Protein sequence:
MEWTWVFLFLLSVTAGVHSQVQLQESGGGLVQPGGSLRLSCAASGRTFSNYVNYAMGWFRQFPG
KEREFVA*SISWSSVTTY*YADSVKGRFTISRDNAKNTVYLQMNSLKPEDTAVYYCAAHLAQYSDYA
YRDPHQFGAWGQGTQVTVSSVKGKHLCPSPLFPGPSKPFWVLVVVGGVLACYSLLVTVAFIIFWV
KRGRKKLLYIFKQPFMRPVQTTQEEDGCSCRFPEEEEGGCELLRVKFSRSADAPAYQQGQNQLYN
ELNLGRREEYDVLDKRRGRDPEMGGKPQRRKNPQEGLYNELQKDKMAEAYSEIGMKGERRRGK
GHDGLYQGLSTATKDTYDALHMQALPPR (SEQ ID NO: 684) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAACCTGGCGGAAGCCTGAGACTGTCTTGTGCCGCTT
CTGGCAGAACCTTCAGCAACTACGTGAACTACGCCATGGGCTGGTTCAGACAGTTCCCCGGCAAA
GAGAGAGAGTTCGTCGCCAGCATCAGCTGGTCTAGCGTGACCACCTACTACGCCGACAGCGTGAA
GGGCAGATTCACCATCAGCAGAGACAACGCCAAGAACACCGTGTACCTGCAGATGAACAGCCTGA
AGCCAGAGGACACCGCCGTGTACTACTGTGCTGCTCACCTGGCTCAGTACAGCGACTACGCCTAC
AGAGATCCCCACCAGTTTGGCGCTTGGGGCCAGGGAACACAAGTGACCGTTAGCTCTGTGAAAGG
GAAACACCTTTGTCCAAGTCCCCTATTTCCCGGACCTTCTAAGCCCTTTTGGGTGCTGGTGGTGG
TTGGTGGAGTCCTGGCTTGCTATAGCTTGCTAGTAACAGTGGCCTTTATTATTTTCTGGGTGAAA
CGGGGCAGAAAGAAACTCCTGTATATATTCAAACAACCATTTATGAGACCAGTACAAACTACTC
AAGAGGAAGATGGCTGTAGCTGCCGATTTCCAGAAGAAGAAGAAGGAGGATGTGAACTGCTTAG
AGTGAAGTTCAGCAGGAGCGCAGACGCCCCCGCGTACCAGCAGGGCCAGAACCAGCTCTATAACG
AGCTCAATCTAGGACGAAGAGAGGAGTACGATGTTTTGGACAAGAGACGTGGCCGGGACCCTGA
GATGGGGGGAAAGCCGCAGAGAAGGAAGAACCCTCAGGAAGGCCTGTACAATGAACTGCAGAAA
GATAAGATGGCGGAGGCCTACAGTGAGATTGGGATGAAAGGCGAGCGCCGGAGGGGCAAGGGGC
ACGATGGCCTTTACCAGGGTCTCAGTACAGCCACCAAGGACACCTACGACGCCCTTCACATGCAG
GCCCTGCCCCCTCGC LS-NbMMRm5.38-CD28H-CD28TM-41BB CS-CD3zICS
(SEQ ID NO: 585) Protein sequence:
MEWTWVFLFLLSVTAGVHSQVQLQESGGGLVQAGGSLRLSCAASGFTDDDYDIGWFRQAPGKER
EGVS*CISSSDGSTY*YADSVKGRFTISSDNAKNTVYLQMNSLKPEDTAVYYCAADFFRWDSGSYYVR
GCRHATYDYWGQGTQVTVSSVKGKHLCPSPLFPGPSKPFWVLVVVGGVLACYSLLVTVAFIIFWV
KRGRKKLLYIFKQPFMRPVQTTQEEDGCSCRFPEEEEGGCELLRVKFSRSADAPAYQQGQNQLYN
ELNLGRREEYDVLDKRRGRDPEMGGKPQRRKNPQEGLYNELQKDKMAEAYSEIGMKGERRRGK
GHDGLYQGLSTATKDTYDALHMQALPPR (SEQ ID NO: 685) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAAGCTGGCGGAAGCCTGAGACTGTCTTGTGCCGCTT
CTGGCTTCACCGACGACGACTACGATATCGGCTGGTTCAGACAGGCCCCTGGCAAAGAGAGAGAG
GGCGTCAGCTGTATCAGCAGCTCTGACGGCTCTACCTACTACGCCGACAGCGTGAAGGGCAGATT
CACCATCAGCAGCGACAACGCCAAGAACACCGTGTACCTGCAGATGAACTCTCTGAAGCCCGAGG
ACACCGCCGTGTACTACTGTGCCGCCGACTTCTTCAGATGGGACAGCGGCAGCTACTACGTGCGG
GGATGTAGACACGCCACCTACGATTACTGGGGCCAGGGCACACAAGTGACCGTGTCATCTGTGAA
AGGGAAACACCTTTGTCCAAGTCCCCTATTTCCCGGACCTTCTAAGCCCTTTTGGGTGCTGGTGG
TGGTTGGTGGAGTCCTGGCTTGCTATAGCTTGCTAGTAACAGTGGCCTTTATTATTTTCTGGGTG
AAACGGGGCAGAAAGAAACTCCTGTATATATTCAAACAACCATTTATGAGACCAGTACAAACTA
CTCAAGAGGAAGATGGCTGTAGCTGCCGATTTCCAGAAGAAGAAGAAGGAGGATGTGAACTGCT
TAGAGTGAAGTTCAGCAGGAGCGCAGACGCCCCCGCGTACCAGCAGGGCCAGAACCAGCTCTATA
ACGAGCTCAATCTAGGACGAAGAGAGGAGTACGATGTTTTGGACAAGAGACGTGGCCGGGACCC
TGAGATGGGGGGAAAGCCGCAGAGAAGGAAGAACCCTCAGGAAGGCCTGTACAATGAACTGCAG
AAAGATAAGATGGCGGAGGCCTACAGTGAGATTGGGATGAAAGGCGAGCGCCGGAGGGGCAAGG
GGCACGATGGCCTTTACCAGGGTCTCAGTACAGCCACCAAGGACACCTACGACGCCCTTCACATG
CAGGCCCTGCCCCCTCGC LS-scFvP4A8VHVL-CD28H-CD28TM-41BBCS-CD3zICS
(SEQ ID NO: 586) Protein sequence:
MEWTWVFLFLLSVTAGVHSQVQLQQSGPEVVRPGVSVKISCKGSGYTFTDYGMHWVKQSHAKSL
EWIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRASKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVKRGRKKLLYIFKQPFMRP
VQTTQEEDGCSCRFPEEEEGGCELLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPR (SEQ ID NO: 686) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATGCACTGGGTGAAGCAGAGTCATGCAAAGAGTCTAGA
GTGGATTGGAGTTATTAGTACTTACAATGGTTATACAAACTACAACCAGAAGTTTAAGGGCAAG APPENDIX-continued

AMINO ACID AND NUCLEIC ACID SEQUENCES

GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAGCAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGAAACGGGGCAGAAAGAAACTCCTGTATATATTCAAACAA
CCATTTATGAGACCAGTACAAACTACTCAAGAGGAAGATGGCTGTAGCTGCCGATTTCCAGAAG
AAGAAGAAGGAGGATGTGAACTGCTTAGAGTGAAGTTCAGCAGGAGCGCAGACGCCCCCGCGTA
CCAGCAGGGCCAGAACCAGCTCTATAACGAGCTCAATCTAGGACGAAGAGAGGAGTACGATGTT
TTGGACAAGAGACGTGGCCGGGACCCTGAGATGGGGGGAAAGCCGCAGAGAAGGAAGAACCCTC
AGGAAGGCCTGTACAATGAACTGCAGAAAGATAAGATGGCGGAGGCCTACAGTGAGATTGGGAT
GAAAGGCGAGCGCCGGAGGGGCAAGGGGCACGATGGCCTTTACCAGGGTCTCAGTACAGCCACCA
AGGACACCTACGACGCCCTTCACATGCAGGCCCTGCCCCCTCGC

LS-scFvP4A8VLVH-CD28H-CD28TM-41BBCS-CD3zICS
(SEQ ID NO: 587) Protein sequence:
MEWTWVFLFLLSVTAGVHSDIVLTQSPASLAVSLGQRATISCRASKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGMHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVKRGRKKLLYIFKQPFMRP
VQTTQEEDGCSCRFPEEEEGGCELLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPR (SEQ ID NO: 687) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAGCAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATGCACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGAAACGGGGCAGAAAGAAACTCCTGTATATATTCAAAC
AACCATTTATGAGACCAGTACAAACTACTCAAGAGGAAGATGGCTGTAGCTGCCGATTTCCAGA
AGAAGAAGAAGGAGGATGTGAACTGCTTAGAGTGAAGTTCAGCAGGAGCGCAGACGCCCCCGCG
TACCAGCAGGGCCAGAACCAGCTCTATAACGAGCTCAATCTAGGACGAAGAGAGGAGTACGATG
TTTTGGACAAGAGACGTGGCCGGGACCCTGAGATGGGGGGAAAGCCGCAGAGAAGGAAGAACCC
TCAGGAAGGCCTGTACAATGAACTGCAGAAAGATAAGATGGCGGAGGCCTACAGTGAGATTGGG
ATGAAAGGCGAGCGCCGGAGGGGCAAGGGGCACGATGGCCTTTACCAGGGTCTCAGTACAGCCAC
CAAGGACACCTACGACGCCCTTCACATGCAGGCCCTGCCCCCTCGC LS-scFvP3G5VHVL-CD28H-CD28TM-41BBCS-CD3zICS
(SEQ ID NO: 588) Protein sequence:
MEWTWVFLFLLSVTAGVHSQVQLQQSGPEVVRPGVSVKISCKGSGYTFTDYGIHWVKQSHAKSLE
WIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRANKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVKRGRKKLLYIFKQPFMRP
VQTTQEEDGCSCRFPEEEEGGCELLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPR (SEQ ID NO: 688) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATACACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAACAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG APPENDIX-continued

AMINO ACID AND NUCLEIC ACID SEQUENCES

GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGAAACGGGGCAGAAAGAAACTCCTGTATATATTCAAACAA
CCATTTATGAGACCAGTACAAACTACTCAAGAGGAAGATGGCTGTAGCTGCCGATTTCCAGAAG
AAGAAGAAGGAGGATGTGAACTGCTTAGAGTGAAGTTCAGCAGGAGCGCAGACGCCCCCGCGTA
CCAGCAGGGCCAGAACCAGCTCTATAACGAGCTCAATCTAGGACGAAGAGAGGAGTACGATGTT
TTGGACAAGAGACGTGGCCGGGACCCTGAGATGGGGGGAAAGCCGCAGAGAAGGAAGAACCCTC
AGGAAGGCCTGTACAATGAACTGCAGAAAGATAAGATGGCGGAGGCCTACAGTGAGATTGGGAT
GAAAGGCGAGCGCCGGAGGGGCAAGGGGCACGATGGCCTTTACCAGGGTCTCAGTACAGCCACCA
AGGACACCTACGACGCCCTTCACATGCAGGCCCTGCCCCCTCGC

LS-scFvP3G5VLVH-CD28H-CD28TM-41BBCS-CD3zICS
(SEQ ID NO: 589) Protein sequence:
MEWTWVFLFLLSVTAGVHSDIVLTQSPASLAVSLGQRATISCRANKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGIHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVKRGRKKLLYIFKQPFMRP
VQTTQEEDGCSCRFPEEEEGGCELLRVKFSRSADAPAYQQGQNQLYNELNLGRREEYDVLDKRRG
RDPEMGGKPQRRKNPQEGLYNELQKDKMAEAYSEIGMKGERRRGKGHDGLYQGLSTATKDTYD
ALHMQALPPR (SEQ ID NO: 689) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAACAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATACACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGAAACGGGGCAGAAAGAAACTCCTGTATATATTCAAAC
AACCATTTATGAGACCAGTACAAACTACTCAAGAGGAAGATGGCTGTAGCTGCCGATTTCCAGA
AGAAGAAGAAGGAGGATGTGAACTGCTTAGAGTGAAGTTCAGCAGGAGCGCAGACGCCCCCGCG
TACCAGCAGGGCCAGAACCAGCTCTATAACGAGCTCAATCTAGGACGAAGAGAGGAGTACGATG
TTTTGGACAAGAGACGTGGCCGGGACCCTGAGATGGGGGGAAAGCCGCAGAGAAGGAAGAACCC
TCAGGAAGGCCTGTACAATGAACTGCAGAAAGATAAGATGGCGGAGGCCTACAGTGAGATTGGG
ATGAAAGGCGAGCGCCGGAGGGGCAAGGGGCACGATGGCCTTTACCAGGGTCTCAGTACAGCCAC
CAAGGACACCTACGACGCCCTTCACATGCAGGCCCTGCCCCCTCGC LS-NbMMRm22.84-CD28H-CD28TM-DAP10CS-CD3zICS
(SEQ ID NO: 590) Protein sequence:
MEWTWVFLFLLSVTAGVHSQVQLQESGGGLVQPGGSLRLSCAASGRTFSNYVNYAMGWFRQFPG
KEREFVA*SISWSSVTTY*YADSVKGRFTISRDNAKNTVYLQMNSLKPEDTAVYYCAAHLAQYSDYA
YRDPHQFGAWGQGTQVTVSSVKGKHLCPSPLFPGPSKPFWVLVVVGGVLACYSLLVTVAFIIFWV
LCARPRRSPAQEDGKVYINMPGRGLRVKFSRSADAPAYQQGQNQLYNELNLGRREEYDVLDKRR
GRDPEMGGKPQRRKNPQEGLYNELQKDKMAEAYSEIGMKGERRRGKGHDGLYQGLSTATKDTY
DALHMQALPPR (SEQ ID NO: 690) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAACCTGGCGGAAGCCTGAGACTGTCTTGTGCCGCTT
CTGGCAGAACCTTCAGCAACTACGTGAACTACGCCATGGGCTGGTTCAGACAGTTCCCCGGCAAA
GAGAGAGAGTTCGTCGCCAGCATCAGCTGGTCTAGCGTGACCACCTACTACGCCGACAGCGTGAA
GGGCAGATTCACCATCAGCAGAGACAACGCCAAGAACACCGTGTACCTGCAGATGAACAGCCTGA
AGCCAGAGGACACCGCCGTGTACTACTGTGCTGCTCACCTGGCTCAGTACAGCGACTACGCCTAC
AGAGATCCCCACCAGTTTGGCGCTTGGGGCCAGGGAACACAAGTGACCGTTAGCTCTGTGAAAGG
GAAACACCTTTGTCCAAGTCCCCTATTTCCCGGACCTTCTAAGCCCTTTTGGGTGCTGGTGGTGG
TTGGTGGAGTCCTGGCTTGCTATAGCTTGCTAGTAACAGTGGCCTTTATTATTTTCTGGGTGCTG
TGCGCACGCCCACGCCGCAGCCCCGCCCAAGAAGATGGCAAAGTCTACATCAACATGCCAGGCAG
GGGCCTTAGAGTGAAGTTCAGCAGGAGCGCAGACGCCCCCGCGTACCAGCAGGGCCAGAACCAGC
TCTATAACGAGCTCAATCTAGGACGAAGAGAGGAGTACGATGTTTTGGACAAGAGACGTGGCCG
GGACCCTGAGATGGGGGGAAAGCCGCAGAGAAGGAAGAACCCTCAGGAAGGCCTGTACAATGAA
CTGCAGAAAGATAAGATGGCGGAGGCCTACAGTGAGATTGGGATGAAAGGCGAGCGCCGGAGGG
GCAAGGGGCACGATGGCCTTTACCAGGGTCTCAGTACAGCCACCAAGGACACCTACGACGCCCTT
CACATGCAGGCCCTGCCCCCTCGC LS-NbMMRm5.38-CD28H-CD28TM-DAP10CS-CD3zICS
(SEQ ID NO: 591) Protein sequence:
MEWTWVFLFLLSVTAGVHSQVQLQESGGGLVQAGGSLRLSCAASGFTDDDYDIGWFRQAPGKER
EGVS*CISSSDGST*YYADSVKGRFTISSDNAKNTVYLQMNSLKPEDTAVYYCAADFFRWDSGSYYVR
GCRHATYDYWGQGTQVTVSSVKGKHLCPSPLFPGPSKPFWVLVVVGGVLACYSLLVTVAFIIFWV APPENDIX-continued

AMINO ACID AND NUCLEIC ACID SEQUENCES

LCARPRRSPAQEDGKVYINMPGRGLRVKFSRSADAPAYQQGQNQLYNELNLGRREEYDVLDKRR
GRDPEMGGKPQRRKNPQEGLYNELQKDKMAEAYSEIGMKGERRRGKGHDGLYQGLSTATKDTY
DALHMQALPPR (SEQ ID NO: 691) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAAGCTGGCGGAAGCCTGAGACTGTCTTGTGCCGCTT
CTGGCTTCACCGACGACGACTACGATATCGGCTGGTTCAGACAGGCCCCTGGCAAAGAGAGAGAG
GGCGTCAGCTGTATCAGCAGCTCTGACGGCTCTACCTACTACGCCGACAGCGTGAAGGGCAGATT
CACCATCAGCAGCGACAACGCCAAGAACACCGTGTACCTGCAGATGAACTCTCTGAAGCCCGAGG
ACACCGCCGTGTACTACTGTGCCGCCGACTTCTTCAGATGGGACAGCGGCAGCTACTACGTGCGG
GGATGTAGACACGCCACCTACGATTACTGGGGCCAGGGCACACAAGTGACCGTGTCATCTGTGAA
AGGGAAACACCTTTGTCCAAGTCCCCTATTTCCCGGACCTTCTAAGCCCTTTTGGGTGCTGGTGG
TGGTTGGTGGAGTCCTGGCTTGCTATAGCTTGCTAGTAACAGTGGCCTTTATTATTTTCTGGGTG
CTGTGCGCACGCCCACGCCGCAGCCCCGCCCAAGAAGATGGCAAAGTCTACATCAACATGCCAGG
CAGGGGCCTTAGAGTGAAGTTCAGCAGGAGCGCAGACGCCCCCGCGTACCAGCAGGGCCAGAACC
AGCTCTATAACGAGCTCAATCTAGGACGAAGAGAGGAGTACGATGTTTTGGACAAGAGACGTGG
CCGGGACCCTGAGATGGGGGGAAAGCCGCAGAGAAGGAAGAACCCTCAGGAAGGCCTGTACAAT
GAACTGCAGAAAGATAAGATGGCGGAGGCCTACAGTGAGATTGGGATGAAAGGCGAGCGCCGGA
GGGGCAAGGGGCACGATGGCCTTTACCAGGGTCTCAGTACAGCCACCAAGGACACCTACGACGCC
CTTCACATGCAGGCCCTGCCCCCTCGC LS-scFvP4A8VHVL-CD28H-CD28TM-DAP10CS-CD3zICS
(SEQ ID NO: 592) Protein sequence:
MEWTWVFLFLLSVTAGVHSQVQLQQSGPEVVRPGVSVKISCKGSGYTFTDYGMHWVKQSHAKSL
EWIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRASKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVLCARPRRSPAQEDGKVYI
NMPGRGLRVKFSRSADAPAYQQGQNQLYNELNLGRREEYDVLDKRRGRDPEMGGKPQRRKNPQ
EGLYNELQKDKMAEAYSEIGMKGERRRGKGHDGLYQGLSTATKDTYDALHMQALPPR (SEQ ID NO: 692) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATGCACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAGCAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGCTGTGCGCACGCCCACGCCGCAGCCCCGCCCAAGAAGATG
GCAAAGTCTACATCAACATGCCAGGCAGGGGCCTTAGAGTGAAGTTCAGCAGGAGCGCAGACGCC
CCCGCGTACCAGCAGGGCCAGAACCAGCTCTATAACGAGCTCAATCTAGGACGAAGAGAGGAGTA
CGATGTTTTGGACAAGAGACGTGGCCGGGACCCTGAGATGGGGGGAAAGCCGCAGAGAAGGAAG
AACCCTCAGGAAGGCCTGTACAATGAACTGCAGAAAGATAAGATGGCGGAGGCCTACAGTGAGA
TTGGGATGAAAGGCGAGCGCCGGAGGGGCAAGGGGCACGATGGCCTTTACCAGGGTCTCAGTAC
AGCCACCAAGGACACCTACGACGCCCTTCACATGCAGGCCCTGCCCCCTCGC LS-scFvP4A8VLVH-CD28H-CD28TM-DAP10CS-CD3zICS
(SEQ ID NO: 593) Protein sequence:
MEWTWVFLFLLSVTAGVHSDIVLTQSPASLAVSLGQRATISCRASKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGMHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVLCARPRRSPAQEDGKVYIN
MPGRGLRVKFSRSADAPAYQQGQNQLYNELNLGRREEYDVLDKRRGRDPEMGGKPQRRKNPQE
GLYNELQKDKMAEAYSEIGMKGERRRGKGHDGLYQGLSTATKDTYDALHMQALPPR (SEQ ID NO: 693) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAGCAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATGCACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG APPENDIX-continued

AMINO ACID AND NUCLEIC ACID SEQUENCES

AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGCTGTGCGCACGCCCACGCCGCAGCCCCGCCCAAGAAGA
TGGCAAAGTCTACATCAACATGCCAGGCAGGGGCCTTAGAGTGAAGTTCAGCAGGAGCGCAGAC
GCCCCCGCGTACCAGCAGGGCCAGAACCAGCTCTATAACGAGCTCAATCTAGGACGAAGAGAGGA
GTACGATGTTTTGGACAAGAGACGTGGCCGGGACCCTGAGATGGGGGGAAAGCCGCAGAGAAGG
AAGAACCCTCAGGAAGGCCTGTACAATGAACTGCAGAAAGATAAGATGGCGGAGGCCTACAGTG
AGATTGGGATGAAAGGCGAGCGCCGGAGGGGCAAGGGGCACGATGGCCTTTACCAGGGTCTCAG
TACAGCCACCAAGGACACCTACGACGCCCTTCACATGCAGGCCCTGCCCCCTCGC

LS-scFvP3G5VHVL-CD28H-CD28TM-DAP10CS-CD3zICS
(SEQ ID NO: 594) Protein sequence:
MEWTWVFLFLLSVTAGVHSQVQLQQSGPEVVRPGVSVKISCKGSGYTFTDYGIHWVKQSHAKSLE
WIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRANKSVSTSSYSYMHWY
QQKPGQPPKLLIKY*ASNLES*GVPARFSGSGSGTDFILNIHPVEEEDAATYYCQHSRELPFTFGSGTK
LEIKVKGKHLCPSPLFPGPSKPFWVLVVVGGVLACYSLLVTVAFIIFWVLCARPRRSPAQEDGKVYI
NMPGRGLRVKFSRSADAPAYQQGQNQLYNELNLGRREEYDVLDKRRGRDPEMGGKPQRRKNPQ
EGLYNELQKDKMAEAYSEIGMKGERRRGKGHDGLYQGLSTATKDTYDALHMQALPPR (SEQ ID NO: 694) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATACACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAACAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAGTGAAAGGGAAACACCTTTGTCCAAGTCCCCTATTTCCCGGACCT
TCTAAGCCCTTTTGGGTGCTGGTGGTGGTTGGTGGAGTCCTGGCTTGCTATAGCTTGCTAGTAAC
AGTGGCCTTTATTATTTTCTGGGTGCTGTGCGCACGCCCACGCCGCAGCCCCGCCCAAGAAGATG
GCAAAGTCTACATCAACATGCCAGGCAGGGGCCTTAGAGTGAAGTTCAGCAGGAGCGCAGACGCC
CCCGCGTACCAGCAGGGCCAGAACCAGCTCTATAACGAGCTCAATCTAGGACGAAGAGAGGAGTA
CGATGTTTTGGACAAGAGACGTGGCCGGGACCCTGAGATGGGGGGAAAGCCGCAGAGAAGGAAG
AACCCTCAGGAAGGCCTGTACAATGAACTGCAGAAAGATAAGATGGCGGAGGCCTACAGTGAGA
TTGGGATGAAAGGCGAGCGCCGGAGGGGCAAGGGGCACGATGGCCTTTACCAGGGTCTCAGTAC
AGCCACCAAGGACACCTACGACGCCCTTCACATGCAGGCCCTGCCCCCTCGC LS-scFvP3G5VLVH-CD28H-CD28TM-DAP10CS-CD3zICS
(SEQ ID NO: 595) Protein sequence:
MEWTWVFLFLLSVTAGVHSDIVLTQSPASLAVSLGQRATISCRANKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGIHWVKQSHAKSLEWIG*VISTY*
*NGYTNYNQKFKG*KATMTVDKSSSTAYMELARLTSEDSAIYYCARAYYGNLYYAMDYWGQGTSVT
VSSVKGKHLCPSPLFPGPSKPFWVLVVVGGVLACYSLLVTVAFIIFWVLCARPRRSPAQEDGKVYIN
MPGRGLRVKFSRSADAPAYQQGQNQLYNELNLGRREEYDVLDKRRGRDPEMGGKPQRRKNPQE
GLYNELQKDKMAEAYSEIGMKGERRRGKGHDGLYQGLSTATKDTYDALHMQALPPR (SEQ ID NO: 695) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAACAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATACACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAGTGAAAGGGAAACACCTTTGTCCAAGTCCCCTATTTCCCGGAC
CTTCTAAGCCCTTTTGGGTGCTGGTGGTGGTTGGTGGAGTCCTGGCTTGCTATAGCTTGCTAGTA
ACAGTGGCCTTTATTATTTTCTGGGTGCTGTGCGCACGCCCACGCCGCAGCCCCGCCCAAGAAGA
TGGCAAAGTCTACATCAACATGCCAGGCAGGGGCCTTAGAGTGAAGTTCAGCAGGAGCGCAGAC
GCCCCCGCGTACCAGCAGGGCCAGAACCAGCTCTATAACGAGCTCAATCTAGGACGAAGAGAGGA
GTACGATGTTTTGGACAAGAGACGTGGCCGGGACCCTGAGATGGGGGGAAAGCCGCAGAGAAGG
AAGAACCCTCAGGAAGGCCTGTACAATGAACTGCAGAAAGATAAGATGGCGGAGGCCTACAGTG
AGATTGGGATGAAAGGCGAGCGCCGGAGGGGCAAGGGGCACGATGGCCTTTACCAGGGTCTCAG
TACAGCCACCAAGGACACCTACGACGCCCTTCACATGCAGGCCCTGCCCCCTCGC APPENDIX-continued

AMINO ACID AND NUCLEIC ACID SEQUENCES

Human glutaredoxin 1 (hGRX1)
(SEQ ID NO: 301) Protein sequence:
MAQEFVNCKIQPGKVVVFIKPTCPYCRRAQEILSQLPIKQGLLEFVDITATNHTNEIQDYLQQLTGA
RTVPRVFIGKDCIGGCSDLVSLQQSGELLTRLKQIGALQ (SEQ ID NO: 401) DNA sequence:
ATGGCTCAAGAGTTTGTGAACTGCAAAATCCAGCCTGGGAAGGTGGTTGTGTTCATCAAGCCCAC
CTGCCCGTACTGCAGGAGGGCCCAAGAGATCCTCAGTCAATTGCCCATCAAACAAGGGCTTCTGG
AATTTGTCGATATCACAGCCACCAACCACACTAACGAGATTCAAGATTATTTGCAACAGCTCACG
GGAGCAAGAACGGTGCCTCGAGTCTTTATTGGTAAAGATTGTATAGGCGGATGCAGTGATCTAG
TCTCTTTGCAACAGAGTGGGGAACTGCTGACGCGGCTAAAGCAGATTGGAGCTCTGCAGTAG Human glutaredoxin 2 (hGRX2)
(SEQ ID NO: 302) Protein sequence:
MESNTSSSLENLATAPVNQIQETISDNCVVIFSKTSCSYCTMAKKLFHDMNVNYKVVELDLLEYGN
QFQDALYKMTGERTVPRIFVNGTFIGGATDTHRLHKEGKLLPLVHQCYLKKSKRKEFQ (SEQ ID NO: 402) DNA sequence:
ATGGAGAGCAATACATCATCATCTTTGGAGAATTTAGCGACGGCGCCTGTGAACCAGATCCAAG
AAACAATTTCTGATAATTGTGTGGTGATTTTCTCAAAAACATCCTGTTCTTACTGTACAATGGCA
AAAAAGCTTTTCCATGACATGAATGTTAACTATAAAGTGGTGGAACTGGACCTGCTTGAATATG
GAAACCAGTTCCAAGATGCTCTTTACAAAATGACTGGTGAAAGAACTGTTCCAAGAATATTTGT
CAATGGTACTTTTATTGGAGGTGCAACTGACACTCATAGGCTTCACAAAGAAGGAAAATTGCTC
CCACTAGTTCATCAGTGTTATTTAAAAAAAAGTAAGAGGAAAGAATTTCAGTGA Human glutaredoxin 3 (hGRX3)
(SEQ ID NO: 303) Protein sequence:
MAAGAAEAAVAAVEEVGSAGQFEELLRLKAKSLLVVHFWAPWAPQCAQMNEVMAELAKELPQV
SFVKLEAEGVPEVSEKYEISSVPTFLFFKNSQKIDRLDGAHAPELTKKVQRHASSGSFLPSANEHLK
EDLNLRLKKLTHAAPCMLFMKGTPQEPRCGFSKQMVEILHKHNIQFSSEDIFSDEEVRQGLKAYSS
WPTYPQLYVSGELIGGLDIIKELEASEELDTICPKAPKLEERLKVLTNKASVMLFMKGNKQEAKCG
FSKQILEILNSTGVEYETFDILEDEEVRQGLKAYSNWPTYPQLYVKGELVGGLDIVKELKENGELLP
ILRGEN (SEQ ID NO: 403) DNA sequence:
ATGGCGGCGGGGGCGGCTGAGGCAGCTGTAGCGGCCGTGGAGGAGGTC
GGCTCAGCCGGGCAGTTTGAGGAGCTGCTGCGCCTCAAAGCCAAGTCCCTCCTTGTGGTCCATTT
CTGGGCACCATGGGCTCCACAGTGTGCACAGATGAACGAAGTTATGGCAGAGTTAGCTAAAGAA
CTCCCTCAAGTTTCATTTGTGAAGTTGGAAGCTGAAGGTGTTCCTGAAGTATCTGAAAAATATG
AAATTAGCTCTGTTCCCACTTTTCTGTTTTTCAAGAATTCTCAGAAAATCGACCGATTAGATGGT
GCACATGCCCCAGAGTTGACCAAAAAAGTTCAGCGACATGCATCTAGTGGCTCCTTCCTACCCAG
CGCTAATGAACATCTTAAAGAAGATCTCAACCTTCGCTTGAAGAAATTGACTCATGCTGCCCCCT
GCATGCTGTTTATGAAAGGAACTCCTCAAGAACCACGCTGTGGTTTCAGCAAGCAGATGGTGGA
AATTCTTCACAAACATAATATTCAGTTTAGCAGTTTTGATATCTTCTCAGATGAAGAGGTTCGA
CAGGGACTCAAAGCCTATTCCAGTTGGCCTACCTATCCTCAGCTCTATGTTTCTGGAGAGCTCAT
AGGAGGACTTGATATAATTAAGGAGCTAGAAGCATCTGAAGAACTAGATACAATTTGTCCCAAA
GCTCCCAAATTAGAGGAAAGGCTCAAAGTGCTGACAAATAAAGCTTCTGTGATGCTCTTTATGA
AAGGAAACAAACAGGAAGCAAAATGTGGATTCAGCAAACAAATTCTGGAAATACTAAATAGTAC
TGGTGTTGAATATGAAACATTCGATATATTGGAGGATGAAGAAGTTCGGCAAGGATTAAAAGCT
TACTCAAATTGGCCAACATACCCTCAGCTGTATGTGAAAGGGGAGCTGGTGGGAGGATTGGATA
TTGTGAAGGAACTGAAAGAAAATGGTGAATTGCTGCCTATACTGAGAGGAGAAAATTAA Human glutaredoxin 5 (hGRX5)
(SEQ ID NO: 305) Protein sequence:
MSGSLGRAAAALLRWGRGAGGGGLWGPGVRAAGSGAGGGGSAEQLDALVKKDKVVVFLKGTPE
QPQCGFSNAVVQILRLHGVRDYAAYNVLDDPELRQGIKDYSNWPTIPQVYLNGEFVGGCDILLQM
HQNGDLVEELKKLGIHSTLLDEKKDQDSK (SEQ ID NO: 405) DNA sequence:
ATGAGCGGGTCCCTCGGCCGAGCTGCGGCGGCTCTGCTCCGCTGGGGGCGCGGCGCGGGCGGCGG
TGGCCTTTGGGGTCCGGGCGTGCGGGCGGCGGGCTCGGGCGCGGGCGGCGGCGGCTCGGCGGAGC
AGTTGGACGCGCTGGTGAAGAAGGACAAGGTGGTGGTCTTCCTCAAGGGGACGCCGGAGCAGCCC
CAGTGCGGCTTCAGCAACGCCGTGGTGCAGATCCTGCGGCTGCACGGCGTCCGCGATTACGCGGC
CTACAACGTGCTGGACGACCCGGAGCTCCGACAAGGCATTAAAGACTATTCCAACTGGCCCACCA
TCCCGCAAGTGTACCTCAATGGCGAGTTTGTAGGGGGCTGTGACATTCTTCTGCAGATGCACCAG
AATGGGGACTTGGTGGAAGAACTGAAAAAGCTGGGGATCCACTCCACCCTTTTAGATGAAAAGA
AAGACCAAGACTCCAAGTGA Mouse glutaredoxin 1 (mGRX1)
(SEQ ID NO: 311) Protein sequence:
MAQEFVNCKIQSGKVVVFIKPTCPYCRKTQEILSQLPFKQGLLEFVDITATNNTSAIQDYLQQLTGA
RTVPRVFIGKDCIGGCSDLISMQQTGELMTRLKQIGALQL (SEQ ID NO: 411) DNA sequence:
ATGGCTCAGGAGTTTGTGAACTGCAAGATCCAGTCTGGGAAGGTGGTCGTGTTCATC
AAGCCCACCTGCCCCTACTGCAGAAAGACCCAAGAAATCCTCAGTCAACTGCCTTTC
AAACAAGGTCTTCTGGAGTTTGTGGACATCACAGCCACTAACAACACCAGTGCGATT

AMINO ACID AND NUCLEIC ACID SEQUENCES

CAAGATTATTTACAACAGCTCACCGGAGCGAGAACAGTTCCTCGGGTCTTCATAGGT
AAAGACTGCATAGGCGGATGCAGTGATCTAATCTCCATGCAACAGACTGGGGAGCT
GATGACTCGGCTGAAGCAGATTGGAGCTCTGCAGTTATAA

Functional human GRX1 variant 2 (hGRX1v2) - “EFVA” mutant
(SEQ ID NO: 322) Protein sequence:
MAQEFVNCKIQPGKVVVFIKPTCPYCRRAQEILSQLPIKQGLLEFVAITATNHTNEIQDYLQQLTGA
RTVPRVFIGKDCIGGCSDLVSLQQSGELLTRLKQIGALQ (SEQ ID NO: 422) DNA sequence:
ATGGCTCAAGAGTTTGTGAACTGCAAAATCCAGCCTGGGAAGGTGGTTGTGTTCATCAAGCCCAC
CTGCCCGTACTGCAGGAGGGCCCAAGAGATCCTCAGTCAATTGCCCATCAAACAAGGGCTTCTGG
AATTTGTCGCTATCACAGCCACCAACCACACTAACGAGATTCAAGATTATTTGCAACAGCTCACG
GGAGCAAGAACGGTGCCTCGAGTCTTTATTGGTAAAGATTGTATAGGCGGATGCAGTGATCTAG
TCTCTTTGCAACAGAGTGGGGAACTGCTGACGCGGCTAAAGCAGATTGGAGCTCTGCAGTAG Functional human GRX1 variant 12 (hGRX1v2) - “C7S C79S C83S” mutant
(SEQ ID NO: 332) Protein sequence:
MAQEFVNSKIQPGKVVVFIKPTCPYCRRAQEILSQLPIKQGLLEFVDITATNHTNEIQDYLQQLTGA
RTVPRVFIGKDSIGGSSDLVSLQQSGELLTRLKQIGALQ (SEQ ID NO: 432) DNA sequence:
ATGGCTCAAGAGTTTGTGAACAGCAAAATCCAGCCTGGGAAGGTGGTTGTGTTCATCAAGCCCA
CCTGCCCGTACTGCAGGAGGGCCCAAGAGATCCTCAGTCAATTGCCCATCAAACAAGGGCTTCTG
GAATTTGTCGATATCACAGCCACCAACCACACTAACGAGATTCAAGATTATTTGCAACAGCTCAC
GGGAGCAAGAACGGTGCCTCGAGTCTTTATTGGTAAAGATTCTATAGGCGGATCCAGTGATCTA
GTCTCTTTGCAACAGAGTGGGGAACTGCTGACGCGGCTAAAGCAGATTGGAGCTCTGCAGTAG Human glutathione S-transferase P(hGSTP)
(SEQ ID NO: 341) Protein sequence:
MPPYTVVYFPVRGRCAALRMLLADQGQSWKEEVVTVETWQEGSLKASCLYGQLPKFQDGDLTLY
QSNTILRHLGRTLGLYGKDQQEAALVDMVNDGVEDLRCKYISLIYTNYEAGKDDYVKALPGQLKP
FETLLSQNQGGKTFIVGDQISFADYNLLDLLLIHEVLAPGCLDAFPLLSAYVGRLSARPKLKAFLASP
EYVNLPINGNGKQ (SEQ ID NO: 441) DNA sequence:
ATGCCGCCCTACACCGTGGTCTATTTCCCAGTTCGAGGCCGCTGCGCGGCCCTGCGC
ATGCTGCTGGCAGATCAGGGCCAGAGCTGGAAGGAGGAGGTGGTGACCGTGGAGAC
GTGGCAGGAGGGCTCACTCAAAGCCTCCTGCCTATACGGGCAGCTCCCCAAGTTCCA
GGACGGAGACCTCACCCTGTACCAGTCCAATACCATCCTGCGTCACCTGGGCCGCAC
CCTTGGGCTCTATGGGAAGGACCAGCAGGAGGCAGCCCTGGTGGACATGGTGAATG
ACGGCGTGGAGGACCTCCGCTGCAAATACGTCTCCCTCATCTACACCAACTATGAGG
CGGGCAAGGATGACTATGTGAAGGCACTGCCCGGGCAACTGAAGCCTTTTGAGACC
CTGCTGTCCCAGAACCAGGGAGGCAAGACCTTCATTGTGGGAGACCAGATCTCCTTC
GCTGACTACAACCTGCTGGACTTGCTGCTGATCCATGAGGTCCTAGCCCCTGGCTGC
CTGGATGCGTTCCCCCTGCTCTCAGCATATGTGGGGCGCCTCAGCGCCCGGCCCAAG
CTCAAGGCCTTCCTGGCCTCCCCTGAGTACGTGAACCTCCCCATCAATGGCAACGGG
AAACAGTGA Mouse glutathione S-transferase P(mGSTP)
(SEQ ID NO: 351) Protein sequence:
MPPYTIVYFPVRGRCEAMRMLLADQGQSWKEEVVTIDTWMQGLLKPTCLYGQLPKFEDGDLTLY
QSNAILRHLGRSLGLYGKNQREAAQMDMVNDGVEDLRGKYVTLIYTNYENGKNDYVKALPGHLK
PFETLLSQNQGGKAFIVGDQISFADYNLLDLLLIHQVLAPGCLDNFPLLSAYVARLSARPKIKAFLSS
PEHVNRPINGNGKQ (SEQ ID NO: 451) DNA sequence:
ATGCCACCATACACCATTGTCTACTTCCCAGTTCGAGGGCGGTGTGAGGCCATGCGA
ATGCTGCTGGCTGACCAGGGCCAGAGCTGGAAGGAGGAGGTGGTTACCATAGATAC
CTGGATGCAAGGCTTGCTCAAGCCCACTTGTCTGTATGGGCAGCTCCCCAAGTTTGA
GGATGGAGACCTCACCCTTTACCAATCTAATGCCATCTTGAGACACCTTGGCCGCTC
TTTGGGGCTTTATGGGAAAAACCAGAGGGAGGCCGCCCAGATGGATATGGTGAATG
ATGGGGTGGAGGACCTTCGCGGCAAATATGTCACCCTCATCTACACCAACTATGAGA
ATGGTAAGAATGACTACGTGAAGGCCCTGCCTGGGCATCTGAAGCCTTTTGAGACCC
TGCTGTCCCAGAACCAGGGAGGCAAAGCTTTCATCGTGGGTGACCAGATCTCCTTTG
CCGATTACAACTTGCTGGACCTGCTGCTGATCCACCAAGTCCTGGCCCCTGGCTGCC
TGGACAACTTCCCCCTGCTCTCTGCCTATGTGGCTCGCCTCAGTGCCCGGCCCAAGA
TCAAGGCCTTTCTGTCCTCCCCGGAACATGTGAACCGTCCCATCAATGGCAATGGCA
AACAGTAG Mouse CD206
(SEQ ID NO: 701) Protein sequence:
MRLLLLLAFISVIPVSVQLLDARQFLIYNEDHKRCVDALSAISVQTATCNPEAESQKFRWVSDSQIM
SVAFKLCLGVPSKTDWASVTLYACDSKSEYQKWECKNDTLEGIKGTELYFNYGNRQEKNIKLYKG
SGLWSRWKVYGTTDDLCSRGYEAMYSLLGNANGAVCAFPFKFENKWYADCTSAGRSDGWLWCG
TTTDYDKDKLFGFCPLHFEGSERLWNKDPLTGILYQINSKSALTWHQARASCKQQNADLLSVTEI
HEQMYLTGLTSSLSSGLWIGLNSLSVRSGWQWAGGSPFRYLNWLPGSPSSEPGKSCVSLNPGKNA
KWENLECVQKLGYICKKGNNTLNPFIIPSASDVPTGCPNQWWPYAGHCYRIHREEKKIQKYALQA APPENDIX-continued

AMINO ACID AND NUCLEIC ACID SEQUENCES

CRKEGGDLASIHSIEEFDFIFSQLGYEPNDELWIGLNDIKIQMYFEWSDGTPVTFTKWLPGEPSHE
NNRQEDCVVMKGKDGYWADRACEQPLGYICKMVSQSHAVVPEGADKGCRKGWKRHGFYCYLIG
STLSTFTDANHTCTNEKAYLTTVEDRYEQAFLTSLVGLRPEKYFWTGLSDVQNKGTFRWTVDEQ
VQFTHWNADMPGRKAGCVAMKTGVAGGLWDVLSCEEKAKFVCKHWAEGVTRPPEPTTTPEPK
CPENWGTTSKTSMCFKLYAKGKHEKKTWFESRDFCKAIGGELASIKSKDEQQVIWRLITSSGSYHE
LFWLGLTYGSPSEGFTWSDGSPVSYENWAYGEPNNYQNVEYCGELKGDPGMSWNDINCEHLNN
WICQIQKGKTLLPEPTPAPQDNPPVTADGWVIYKDYQYYFSKEKETMDNARAFCKKNEGDLATIK
SESEKKFLWKYINKNGGQSPYFIGMLISMDKKFIWMDGSKVDFVAWATGEPNFANDDENCVTMY
TNSGFWNDINCGYPNNFICQRHNSSINATAMPTTPTTPGGCKEGWHLYKNKCFKIFGFANEEKKS
WQDARQACKGLKGNLVSIENAQEQAFVTYHMRDSTFNAWTGLNDINAEHMFLWTAGQGVHYT
NWGKGYPGGRRSSLSYEDADCVVVIGGNSREAGTWMDDTCDSKQGYICQTQTDPSLPVSPTTTPK
DGFVTYGKSSYSLMKLKLPWHEAETYCKDHTSLLASILDPYSNAFAWMKMHPFNVPIWIALNSN
LTNNEYTWTDRWRVRYTNWGADEPKLKSACVYMDVDGYWRTSYCNESFYFLCKKSDEIPATEP
PQLPGKCPESEQTAWIPFYGHCYYFESSFTRSWGQASLECLRMGASLVSIETAAESSFLSYRVEPLK
SKTNFWIGMFRNVEGKWLWLNDNPVSFVNWKTGDPSGERNDCVVLASSSGLWNNIHCSSYKGF
ICKMPKIIDPVTTHSSITTKADQRKMDPQPKGSSKAAGVVTVVLLIVIGAGVAAYFFYKKRHALHIP
QEATFENTLYFNSNLSPGTSDTKDLMGNIEQNEHAII

Mouse CD163
(SEQ ID NO: 702) Protein sequence:
MGGHRMVLLGGAGSPGCKRFVHLGFFVVAVSSLLSASAVTNAPGEMKKELRLAGGENNCSGRVEL
KIHDKWGTVCSNGWSMNEVSVVCQQLGCPTSIKALGWANSSAGSGYIWMDKVSCTGNESALWD
CKHDGWGKHNCTHEKDAGVTCSDGSNLEMRLVNSAGHRCLGRVEIKFQGKWGTVCDDNFSKDH
ASVICKQLGCGSAISFSGSAKLGAGSGPIWLDDLACNGNESALWDCKHRGWGKHNCDHAEDVGVI
CLEGADLSLRLVDGVSRCSGRLEVRFQGEWGTVCDDNWDLRDASVVCKQLGCPTAISAIGRVNAS
EGSGQIWLDNISCEGHEATLWECKHQEWGKHYCHHREDAGVTCSDGADLELRLVGGGSRCAGIV
EVEIQKLTGKMCSRGWTLADADVVCRQLGCGSALQTQAKIYSKTGATNTWLFPGSCNGNETTFW
QCKNWQWGGLSCDNFEEAKVTCSGHREPRLVGGEIPCSGRVEVKHGDVWGSVCDFDLSLEAASV
VCRELQCGTVVSILGGAHFGEGSGQIWGEEFQCSGDESHLSLCSVAPPLDRTCTHSRDVSVVCSRYI
DIRLAGGESSCEGRVELKTLGAWGPLCSSHWDMEDAHVLCQQLKCGVAQSIPEGAHFGKGAGQV
WSHMFHCTGTEEHIGDCLMTALGAPTCSEGQVASVICSGNQSQTLLPCSSLSPVQTTSSTIPKESEV
PCIASGQLRLVGGGGRCAGRVEVYHEGSWGTVCDDNWDMTDANVVCKQLDCGVAINATGSAYFG
EGAGAIWLDEVICTGKESHIWQCHSHGWGRHNCRHKEDAGVICSEFMSLRLTNEAHKENCTGRL
EVFYNGTWGSIGSSNMSPTTVGVVCRQLGCADNGTVKPIPSDKTPSRPMVVVDRVQCPKGVDTLW
QCPSSPWKQRQASPSSQESWIICDNKIRLQEGHTDCSGRVEIWHKGSWGTVCDDSWDLNDAKVV
CKQLGCGQAVKALKEAAFGPGTGPIWLNEIKCRGNESSLWDCPAKPWSHSDCGHKEDASIQCLPK
MTSESHHGTGHPTLTALLVCGAILLVLLIVFLLWTLKRRQIQRLTVSSRGEVLIHQVQYQEMDSKA
DDLDLLKSSENSNNSYDFNDDGLTSLSKYLPISGIKKGSFRGTLRRKMHYNPLRLEFKKP Mouse Fn14
(SEQ ID NO: 703) Protein sequence:
MASAWPRSLPQILVLGFGLVLMRAAAGEQAPGTSPCSSGSSWSADLDKCMDCASCPARPHSDFCL
GCAAAPPAHFRLLWPILGGALSLVLVLALVSSFLVWRRCRRREKFTTPIEETGGEGCPGVALIQ Mouse CD28 hinge (mCD28H)
(SEQ ID NO: 745) Protein sequence:
IKEKHLCHTQSSPKL (SEQ ID NO: 845) DNA sequence:
ATCAAGGAGAAGCACCTGTGCCACACCCAGAGCAGCCCCAAGCTG Mouse CD28 transmembrane domain (mCD28TM)
(SEQ ID NO: 746) Protein sequence:
FWALVVVAGVLFCYGLLVTVALCVIWT (SEQ ID NO: 846) DNA sequence:
TTCTGGGCCCTGGTGGTGGTGGCCGGCGTGCTGTTCTGCTACGGCCTGCTGGTGACCGTGGCCCT
GTGCGTGATCTGGACC Mouse CD3 zeta intracellular signaling domain (mCD3zICS)
(SEQ ID NO: 747) Protein sequence:
RAKFSRSAETAANLQDPNQLYNELNLGRREEYDVLEKKRARDPEMGGKQQRRRNPQEGVYNAL
QKDKMAEAYSEIGTKGERRRGKGHDGLYQGLSTATKDTYDALHMQTLAPR (SEQ ID NO: 847) DNA sequence:
AGGGCCAAGTTCAGCAGGAGCGCCGAGACCGCCGCCAACCTGCAGGACCCCAACCAGCTGTACAA
CGAGCTGAACCTGGGCAGGAGGGAGGAGTACGACGTGCTGGAGAAGAAGAGGGCCAGGGACCCC
GAGATGGGCGGCAAGCAGCAGAGGAGGAGGAACCCCCAGGAGGGCGTGTACAACGCCCTGCAGA
AGGACAAGATGGCCGAGGCCTACAGCGAGATCGGCACCAAGGGCGAGAGGAGGAGGGGCAAGGG
CCACGACGGCCTGTACCAGGGCCTGAGCACCGCCACCAAGGACACCTACGACGCCCTGCACATGC
AGACCCTGGCCCCCAGG Mouse truncated CD19 (mtrCD19)
(SEQ ID NO: 751) Protein sequence:
MPSPLPVSFLLFLTLVGGRPQKSLLVEVEEGGNVVLPCLPDSSPVSSEKLAWYRGNQSTPFLELSPG
SPGLGLHVGSLGILLVIVNVSDHMGGFYLCQKRPPFKDIWQPAWTVNVEDSGEMFRWNASDVRD APPENDIX-continued

AMINO ACID AND NUCLEIC ACID SEQUENCES

LDCDLRNRSSGSHRSTSGSQLYVWAKDHPKVWGTKPVCAPRGSSLNQSLINQDLTVAPGSTLWLS
CGVPPVPVAKGSISWTHVHPRRPNVSLLSLSLGGEHPVREMWVWGSLLLLPQATALDEGTYYCLR
GNLTIERHVKVIARSAVWLWLLRTGGWIVPVVTLVYVIFCMVSLVAFLYCQRAFILRRKRKRMT (SEQ ID NO: 851) DNA sequence:
ATGCCATCTCCTCTGCCTGTGTCCTTCCTGCTGTTCCTGACACTCGTCGGCGGCAGACCTCAGAAG
TCTCTGCTGGTTGAGGTGGAAGAGGGCGGCAATGTGGTGCTGCCTTGTCTGCCTGATAGCAGCCC
TGTGTCCAGCGAGAAGCTGGCTTGGTACAGAGGCAACCAGAGCACCCCATTTCTGGAACTGAGCC
CTGGCTCTCCTGGACTGGGACTGCATGTTGGATCTCTGGGCATCCTGCTGGTCATCGTGAACGTG
TCCGATCACATGGGCGGCTTCTACCTGTGCCAGAAGAGGCCTCCATTCAAGGACATCTGGCAGCC
TGCCTGGACCGTGAACGTTGAGGATAGCGGCGAGATGTTCAGATGGAACGCCAGCGACGTGCGCG
ACCTGGACTGTGACCTGAGAAACAGAAGCAGCGGCAGCCACAGAAGCACCTCTGGCTCTCAGCTG
TACGTGTGGGCCAAAGATCACCCCAAAGTGTGGGGCACCAAGCCTGTGTGTGCTCCTAGAGGCAG
CAGCCTGAACCAGAGCCTGATCAACCAGGACCTGACAGTGGCTCCTGGCAGCACACTGTGGCTGT
CTTGCGGAGTTCCTCCAGTGCCTGTGGCCAAGGGCAGCATCTCTTGGACACACGTGCACCCTAGA
AGGCCCAACGTGTCCCTGCTGTCTCTGTCTCTCGGCGGAGAACATCCCGTGCGCGAGATGTGGGT
TTGGGGATCTCTTCTGCTGCTGCCACAGGCCACAGCTCTGGATGAGGGCACCTACTACTGCCTGA
GGGGCAACCTGACCATCGAGAGACACGTGAAAGTGATCGCCAGATCCGCCGTGTGGCTCTGGCTT
CTTAGAACAGGCGGATGGATCGTGCCCGTGGTCACCCTGGTGTACGTGATCTTCTGCATGGTGTC
CCTGGTGGCCTTCCTGTACTGCCAGAGAGCCTTCATCCTGAGAAGAAAGCGCAAGCGGATGACCT
GATGA Mouse CD28 costimulatory domain (mCD28CS)
(SEQ ID NO: 756) Protein sequence:
NSRRNRLLQSDYMNMTPRRPGLTRKPYQPYAPARDFAAYRP (SEQ ID NO: 856) DNA sequence:
AACAGCAGGAGGAACAGGCTGCTGCAGAGCGACTACATGAACATGACCCCCAGGAGGCCCGGCCT
GACCAGGAAGCCCTACCAGCCCTACGCCCCCGCCAGGGACTTCGCCGCCTACAGGCCC Full CAR sequences, suitable for use in mice
NbMMRm22.84-mCD28H-mCD28TM-mCD28CS-mCD3zICS
(SEQ ID NO: 760) Protein sequence:
QVQLQESGGGLVQPGGSLRLSCAASGRTFSNYVNYAMGWFRQFPGKEREFVA*SISWSSVTT*YYADS
VKGRFTISRDNAKNTVYLQMNSLKPEDTAVYYCAAHLAQYSDYAYRDPHQFGAWGQGTQVTVS
SIKEKHLCHTQSSPKLFWALVVVAGVLFCYGLLVTVALCVIWTNSRRNRLLQSDYMNMTPRRPGL
TRKPYQPYAPARDFAAYRPRAKFSRSAETAANLQDPNQLYNELNLGRREEYDVLEKKRARDPEM
GGKQQRRRNPQEGVYNALQKDKMAEAYSEIGTKGERRRGKGHDGLYQGLSTATKDTYDALHMQ
TLAPR (SEQ ID NO: 860) DNA sequence:
CAGGTTCAGCTGCAAGAGTCTGGCGGAGGACTGGTTCAACCTGGCGGAAGCCTGAGACTGTCTTG
TGCCGCTTCTGGCAGAACCTTCAGCAACTACGTGAACTACGCCATGGGCTGGTTCAGACAGTTCC
CCGGCAAAGAGAGAGAGTTCGTCGCCAGCATCAGCTGGTCTAGCGTGACCACCTACTACGCCGAC
AGCGTGAAGGGCAGATTCACCATCAGCAGAGACAACGCCAAGAACACCGTGTACCTGCAGATGA
ACAGCCTGAAGCCAGAGGACACCGCCGTGTACTACTGTGCTGCTCACCTGGCTCAGTACAGCGAC
TACGCCTACAGAGATCCCCACCAGTTTGGCGCTTGGGGCCAGGGAACACAAGTGACCGTTAGCTC
TATCAAGGAGAAGCACCTGTGCCACACCCAGAGCAGCCCCAAGCTGTTCTGGGCCCTGGTGGTGG
TGGCCGGCGTGCTGTTCTGCTACGGCCTGCTGGTGACCGTGGCCCTGTGCGTGATCTGGACCAAC
AGCAGGAGGAACAGGCTGCTGCAGAGCGACTACATGAACATGACCCCCAGGAGGCCCGGCCTGAC
CAGGAAGCCCTACCAGCCCTACGCCCCCGCCAGGGACTTCGCCGCCTACAGGCCCAGGGCCAAGTT
CAGCAGGAGCGCCGAGACCGCCGCCAACCTGCAGGACCCCAACCAGCTGTACAACGAGCTGAACC
TGGGCAGGAGGGAGGAGTACGACGTGCTGGAGAAGAAGAGGGCCAGGGACCCCGAGATGGGCGG
CAAGCAGCAGAGGAGGAGGAACCCCCAGGAGGGCGTGTACAACGCCCTGCAGAAGGACAAGATG
GCCGAGGCCTACAGCGAGATCGGCACCAAGGGCGAGAGGAGGAGGGGCAAGGGCCACGACGGCCT
GTACCAGGGCCTGAGCACCGCCACCAAGGACACCTACGACGCCCTGCACATGCAGACCCTGGCCCC
CAGG NbMMRm5.38-mCD28H-mCD28TM-mCD28CS-mCD3zICS
(SEQ ID NO: 761) Protein sequence:
QVQLQESGGGLVQAGGSLRLSCAASGFTDDDYDIGWFRQAPGKEREGVS*CISSSDGST*YYADSVKG
RFTISSDNAKNTVYLQMNSLKPEDTAVYYCAADFFRWDSGSYYVRGCRHATYDYWGQGTQVTV
SSIKEKHLCHTQSSPKLFWALVVVAGVLFCYGLLVTVALCVIWTNSRRNRLLQSDYMNMTPRRPG
LTRKPYQPYAPARDFAAYRPRAKFSRSAETAANLQDPNQLYNELNLGRREEYDVLEKKRARDPE
MGGKQQRRRNPQEGVYNALQKDKMAEAYSEIGTKGERRRGKGHDGLYQGLSTATKDTYDALHM
QTLAPR (SEQ ID NO: 861) DNA sequence:
CAGGTTCAGCTGCAAGAGTCTGGCGGAGGACTGGTTCAAGCTGGCGGAAGCCTGAGACTGTCTTG
TGCCGCTTCTGGCTTCACCGACGACGACTACGATATCGGCTGGTTCAGACAGGCCCCTGGCAAAG
AGAGAGAGGGCGTCAGCTGTATCAGCAGCTCTGACGGCTCTACCTACTACGCCGACAGCGTGAAG
GGCAGATTCACCATCAGCAGCGACAACGCCAAGAACACCGTGTACCTGCAGATGAACTCTCTGAA
GCCCGAGGACACCGCCGTGTACTACTGTGCCGCCGACTTCTTCAGATGGGACAGCGGCAGCTACT
ACGTGCGGGGATGTAGACACGCCACCTACGATTACTGGGGCCAGGGCACACAAGTGACCGTGTCA
TCTATCAAGGAGAAGCACCTGTGCCACACCCAGAGCAGCCCCAAGCTGTTCTGGGCCCTGGTGGT
GGTGGCCGGCGTGCTGTTCTGCTACGGCCTGCTGGTGACCGTGGCCCTGTGCGTGATCTGGACCA
ACAGCAGGAGGAACAGGCTGCTGCAGAGCGACTACATGAACATGACCCCCAGGAGGCCCGGCCTG
ACCAGGAAGCCCTACCAGCCCTACGCCCCCGCCAGGGACTTCGCCGCCTACAGGCCCAGGGCCAAG

AMINO ACID AND NUCLEIC ACID SEQUENCES

TTCAGCAGGAGCGCCGAGACCGCCGCCAACCTGCAGGACCCCAACCAGCTGTACAACGAGCTGAA
CCTGGGCAGGAGGGAGGAGTACGACGTGCTGGAGAAGAAGAGGGCCAGGGACCCCGAGATGGGC
GGCAAGCAGCAGAGGAGGAGGAACCCCCAGGAGGGCGTGTACAACGCCCTGCAGAAGGACAAGA
TGGCCGAGGCCTACAGCGAGATCGGCACCAAGGGCGAGAGGAGGAGGGGCAAGGGCCACGACGG
CCTGTACCAGGGCCTGAGCACCGCCACCAAGGACACCTACGACGCCCTGCACATGCAGACCCTGG
CCCCCAGG scFvP4A8VHVL-mCD28H-mCD28TM-mCD28CS-mCD3zICS
(SEQ ID NO: 762) Protein sequence:
QVQLQQSGPEVVRPGVSVKISCKGSGYTFTDYGMHWVKQSHAKSLEWIG*VISTYNGYTNYNQKFK*
*G*KATMTVDK*S*SSTAYMELARLTSEDSAIYYCARAYYGNLYYAMDYWGQGTSVTV*S*SGGGGSGGG
GSGGGGSDIVLTQSPASLAVSLGQRATISCRASKSVSTSSYSYMHWYQQKPGQPPKLLIKY*ASNLES*
GVPARFSGSGSGTDFILNIHPVEEEDAATYYCQHSRELPFTFGSGTKLEIKIEKHLCHTQSSPKLF
WALVVVAGVLFCYGLLVTVALCVIWTNSRRNRLLQSDYMNMTPRRPGLTRKPYQPYAPARDFAA
YRPRAKFSRSAETAANLQDPNQLYNELNLGRREEYDVLEKKRARDPEMGGKQQRRRNPQEGVY
NALQKDKMAEAYSEIGTKGERRRGKGHDGLYQGLSTATKDTYDALHMQTLAPR (SEQ ID NO: 762) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATGCACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAGCAAAAGTGTCAGTACATCTAGCTATAGTTATAT
GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAAATCAAGGAGAAGCACCTGTGCCACACCCAGAGCAGC
CCCAAGCTGTTCTGGGCCCTGGTGGTGGTGGCCGGCGTGCTGTTCTGCTACGGCCTGCTGGTGAC
CGTGGCCCTGTGCGTGATCTGGACCAACAGCAGGAGGAACAGGCTGCTGCAGAGCGACTACATGA
ACATGACCCCCAGGAGGCCCGGCCTGACCAGGAAGCCCTACCAGCCCTACGCCCCCGCCAGGGACT
TCGCCGCCTACAGGCCCAGGGCCAAGTTCAGCAGGAGCGCCGAGACCGCCGCCAACCTGCAGGAC
CCCAACCAGCTGTACAACGAGCTGAACCTGGGCAGGAGGGAGGAGTACGACGTGCTGGAGAAGA
AGAGGGCCAGGGACCCCGAGATGGGCGGCAAGCAGCAGAGGAGGAGGAACCCCCAGGAGGGCGT
GTACAACGCCCTGCAGAAGGACAAGATGGCCGAGGCCTACAGCGAGATCGGCACCAAGGGCGAGA
GGAGGAGGGGCAAGGGCCACGACGGCCTGTACCAGGGCCTGAGCACCGCCACCAAGGACACCTAC
GACGCCCTGCACATGCAGACCCTGGCCCCCAGG scFvP4A8VLVH-mCD28H-mCD28TM-mCD28CS-mCD3zICS
(SEQ ID NO: 763) Protein sequence:
DIVLTQSPASLAVSLGQRATISCRASKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQ*S*
GPEVVRPGVSVKISCKGSGYTFTDYGMHWVKQSHAKSLEWIG*VISTYNGYTNYNQKFKG*KATMTV
DK*S*SSTAYMELARLTSEDSAIYYCARAYYGNLYYAMDYWGQGTSVTV*S*SIKEKHLCHTQSSPKLF
WALVVVAGVLFCYGLLVTVALCVIWTNSRRNRLLQSDYMNMTPRRPGLTRKPYQPYAPARDFAA
YRPRAKFSRSAETAANLQDPNQLYNELNLGRREEYDVLEKKRARDPEMGGKQQRRRNPQEGVY
NALQKDKMAEAYSEIGTKGERRRGKGHDGLYQGLSTATKDTYDALHMQTLAPR (SEQ ID NO: 863) DNA sequence:
GACATTGTGCTGACACAGTCTCCTGCTTCCTTAGCTGTATCTCTGGGGCAGAGGGCCACCATCTC
ATGCAGGGCCAGCAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATGCACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCAATCAAGGAGAAGCACCTGTGCCACACCCAGAGCAGC
CCCAAGCTGTTCTGGGCCCTGGTGGTGGTGGCCGGCGTGCTGTTCTGCTACGGCCTGCTGGTGAC
CGTGGCCCTGTGCGTGATCTGGACCAACAGCAGGAGGAACAGGCTGCTGCAGAGCGACTACATGA
ACATGACCCCCAGGAGGCCCGGCCTGACCAGGAAGCCCTACCAGCCCTACGCCCCCGCCAGGGACT
TCGCCGCCTACAGGCCCAGGGCCAAGTTCAGCAGGAGCGCCGAGACCGCCGCCAACCTGCAGGAC
CCCAACCAGCTGTACAACGAGCTGAACCTGGGCAGGAGGGAGGAGTACGACGTGCTGGAGAAGA
AGAGGGCCAGGGACCCCGAGATGGGCGGCAAGCAGCAGAGGAGGAGGAACCCCCAGGAGGGCGT
GTACAACGCCCTGCAGAAGGACAAGATGGCCGAGGCCTACAGCGAGATCGGCACCAAGGGCGAGA
GGAGGAGGGGCAAGGGCCACGACGGCCTGTACCAGGGCCTGAGCACCGCCACCAAGGACACCTAC
GACGCCCTGCACATGCAGACCCTGGCCCCCAGG scFvP3G5VHVL-mCD28H-mCD28TM-mCD28CS-mCD3zICS
(SEQ ID NO: 764) Protein sequence:
QVQLQQSGPEVVRPGVSVKISCKGSGYTFTDYGIHWVKQSHAKSLEWIG*VISTYNGYTNYNQKFKG*
KATMTVDK*S*SSTAYMELARLTSEDSAIYYCARAYYGNLYYAMDYWGQGTSVTVSSGGGGSGGGG
SGGGGSDIVLTQSPASLAVSLGQRATISCRANKSVSTSSYSYMHWYQQKPGQPPKLLIKY*ASNLES*G APPENDIX-continued

AMINO ACID AND NUCLEIC ACID SEQUENCES

VPARFSGSGSGTDFILNIHPVEEEDAATYYCQHSRELPFTFGSGTKLEIKIKEKHLCHTQSSPKLFW
ALVVVAGVLFCYGLLVTVALCVIWTNSRRNRLLQSDYMNMTPRRPGLTRKPYQPYAPARDFAAY
RPRAKFSRSAETAANLQDPNQLYNELNLGRREEYDVLEKKRARDPEMGGKQQRRRNPQEGVYN
ALQKDKMAEAYSEIGTKGERRRGKGHDGLYQGLSTATKDTYDALHMQTLAPR (SEQ ID NO: 864) DNA sequence:
CAGGTCCAGCTGCAGCAGTCTGGGCCTGAGGTGGTGAGGCCTGGGGTCTCAGTGAAGATTTCCTG
CAAGGGTTCCGGCTACACATTCACTGATTATGGTATACACTGGGTGAAGCAGAGTCATGCAAAG
AGTCTAGAGTGGATTGGAGTTATTAGTACTTACAATGGTTATACAAACTACAACCAGAAGTTTA
AGGGCAAGGCCACAATGACTGTAGACAAATCCTCCAGCACAGCCTATATGGAACTTGCCAGATTG
ACATCTGAGGATTCTGCCATCTATTACTGTGCAAGAGCCTACTATGGTAACCTTTACTATGCTAT
GGACTACTGGGGTCAAGGAACCTCAGTCACCGTCTCCTCAGGTGGTGGTGGTTCTGGCGGCGGCG
GCTCCGGTGGTGGTGGTTCCGACATTGTGCTGACACAGTCTCCTGCTTCCTTAGCTGTATCTCTG
GGGCAGAGGGCCACCATCTCATGCAGGGCCAACAAAAGTGTCAGTACATCTAGCTATAGTTATAT
GCACTGGTACCAACAGAAACCAGGACAGCCACCCAAACTCCTCATCAAGTATGCATCCAACCTAG
AATCTGGGGTCCCTGCCAGGTTCAGTGGCAGTGGGTCTGGGACAGACTTCATCCTCAACATCCAT
CCAGTGGAGGAGGAGGATGCTGCAACCTATTACTGTCAGCACAGTAGGGAGCTTCCATTCACGTT
CGGCTCGGGGACAAAGTTGGAAATAAAAATCAAGGAGAAGCACCTGTGCCACACCCAGAGCAGC
CCCAAGCTGTTCTGGGCCCTGGTGGTGGTGGCCGGCGTGCTGTTCTGCTACGGCCTGCTGGTGAC
CGTGGCCCTGTGCGTGATCTGGACCAACAGCAGGAGGAACAGGCTGCTGCAGAGCGACTACATGA
ACATGACCCCCAGGAGGCCCGGCCTGACCAGGAAGCCCTACCAGCCCTACGCCCCCGCCAGGGACT
TCGCCGCCTACAGGCCCAGGGCCAAGTTCAGCAGGAGCGCCGAGACCGCCGCCAACCTGCAGGAC
CCCAACCAGCTGTACAACGAGCTGAACCTGGGCAGGAGGGAGGAGTACGACGTGCTGGAGAAGA
AGAGGGCCAGGGACCCCGAGATGGGCGGCAAGCAGCAGAGGAGGAGGAACCCCCAGGAGGGCGT
GTACAACGCCCTGCAGAAGGACAAGATGGCCGAGGCCTACAGCGAGATCGGCACCAAGGGCGAGA
GGAGGAGGGGCAAGGGCCACGACGGCCTGTACCAGGGCCTGAGCACCGCCACCAAGGACACCTAC
GACGCCCTGCACATGCAGACCCTGGCCCCCAGG scFvP3G5VLVH-mCD28H-mCD28TM-mCD28CS-mCD3zICS
(SEQ ID NO: 765) Protein sequence:
DIVLTQSPASLAVSLGQRATISCRANKSVSTSSYSYMHWYQQKPGQPPKLLIKY*ASNLES*GVPARFS
GSGSGTDFILNIHPVEEEDAATYYCQHSRELPFTFGSGTKLEIKGGGGSGGGGSGGGGSQVQLQQS
GPEVVRPGVSVKISCKGSGYTFTDYGIHWVKQSHAKSLEWIG*VISTYNGYTNYNQKFKG*KATMTVD
KSSSTAYMELARLTSEDSAIYYCARAYYGNLYYAMDYWGQGTSVTVSSIKEKHLCHTQSSPKLFW
ALVVVAGVLFCYGLLVTVALCVIWTNSRRNRLLQSDYMNMTPRRPGLTRKPYQPYAPARDFAAY
RPRAKFSRSAETAANLQDPNQLYNELNLGRREEYDVLEKKRARDPEMGGKQQRRRNPQEGVYN
ALQKDKMAEAYSEIGTKGERRRGKGHDGLYQGLSTATKDTYDALHMQTLAPR (SEQ ID NO: 865) DNA sequence:
GACATTGTGCTGACACAGTCTCCTGCTTCCTTAGCTGTATCTCTGGGGCAGAGGGCCACCATCTC
ATGCAGGGCCAACAAAAGTGTCAGTACATCTAGCTATAGTTATATGCACTGGTACCAACAGAAA
CCAGGACAGCCACCCAAACTCCTCATCAAGTATGCATCCAACCTAGAATCTGGGGTCCCTGCCAG
GTTCAGTGGCAGTGGGTCTGGGACAGACTTCATCCTCAACATCCATCCAGTGGAGGAGGAGGATG
CTGCAACCTATTACTGTCAGCACAGTAGGGAGCTTCCATTCACGTTCGGCTCGGGGACAAAGTTG
GAAATAAAAGGTGGTGGTGGTTCTGGCGGCGGCGGCTCCGGTGGTGGTGGTTCCCAGGTCCAGCT
GCAGCAGTCTGGGCCTGAGGTGGTGAGGCCTGGGGTCTCAGTGAAGATTTCCTGCAAGGGTTCCG
GCTACACATTCACTGATTATGGTATACACTGGGTGAAGCAGAGTCATGCAAAGAGTCTAGAGTG
GATTGGAGTTATTAGTACTTACAATGGTTATACAAACTACAACCAGAAGTTTAAGGGCAAGGCC
ACAATGACTGTAGACAAATCCTCCAGCACAGCCTATATGGAACTTGCCAGATTGACATCTGAGGA
TTCTGCCATCTATTACTGTGCAAGAGCCTACTATGGTAACCTTTACTATGCTATGGACTACTGGG
GTCAAGGAACCTCAGTCACCGTCTCCTCAATCAAGGAGAAGCACCTGTGCCACACCCAGAGCAGC
CCCAAGCTGTTCTGGGCCCTGGTGGTGGTGGCCGGCGTGCTGTTCTGCTACGGCCTGCTGGTGAC
CGTGGCCCTGTGCGTGATCTGGACCAACAGCAGGAGGAACAGGCTGCTGCAGAGCGACTACATGA
ACATGACCCCCAGGAGGCCCGGCCTGACCAGGAAGCCCTACCAGCCCTACGCCCCCGCCAGGGACT
TCGCCGCCTACAGGCCCAGGGCCAAGTTCAGCAGGAGCGCCGAGACCGCCGCCAACCTGCAGGAC
CCCAACCAGCTGTACAACGAGCTGAACCTGGGCAGGAGGGAGGAGTACGACGTGCTGGAGAAGA
AGAGGGCCAGGGACCCCGAGATGGGCGGCAAGCAGCAGAGGAGGAGGAACCCCCAGGAGGGCGT
GTACAACGCCCTGCAGAAGGACAAGATGGCCGAGGCCTACAGCGAGATCGGCACCAAGGGCGAGA
GGAGGAGGGGCAAGGGCCACGACGGCCTGTACCAGGGCCTGAGCACCGCCACCAAGGACACCTAC
GACGCCCTGCACATGCAGACCCTGGCCCCCAGG mCD3zICS-mCD28CS-mTWEAK
(SEQ ID NO: 766) Protein sequence:
RAKFSRSAETAANLQDPNQLYNELNLGRREEYDVLEKKRARDPEMGGKQQRRRNPQEGVYNAL
QKDKMAEAYSEIGTKGERRRGKGHDGLYQGLSTATKDTYDALHMQTLAPRNSRRNRLLQSDYM
NMTPRRPGLTRKPYQPYAPARDFAAYRPAARRSQRRRGRRGEPGTALLAPLVLSLGLALACLGLL
LVVVSLGSWATLSAQEPSQEELTAEDRREPPELNPQTEESQDVVPFLEQLVRPRRSAPKGRKARP
RRAIAAHYEVHPRPGQDGAQAGVDGTVSGWEETKINSSSPLRYDRQIGEFTVIRAGLYYLYCQVHF
DEGKAVYLKLDLLVNGVLALRCLEEFSATAASSPGPQLRLCQVSGLLPLRPGSSLRIRTLPWAHLK
AAPFLTYFGLFQVH (SEQ ID NO: 866) DNA sequence:
AGGGCCAAGTTCAGCAGGAGCGCCGAGACCGCCGCCAACCTGCAGGACCCCAACCAGCTGTACAA
CGAGCTGAACCTGGGCAGGAGGGAGGAGTACGACGTGCTGGAGAAGAAGAGGGCCAGGGACCCC
GAGATGGGCGGCAAGCAGCAGAGGAGGAGGAACCCCCAGGAGGGCGTGTACAACGCCCTGCAGA
AGGACAAGATGGCCGAGGCCTACAGCGAGATCGGCACCAAGGGCGAGAGGAGGAGGGGCAAGGG
CCACGACGGCCTGTACCAGGGCCTGAGCACCGCCACCAAGGACACCTACGACGCCCTGCACATGC
AGACCCTGGCCCCCAGGAACAGCAGGAGGAACAGGCTGCTGCAGAGCGACTACATGAACATGACC APPENDIX-continued

AMINO ACID AND NUCLEIC ACID SEQUENCES

CCCAGGAGGCCCGGCCTGACCAGGAAGCCCTACCAGCCCTACGCCCCCGCCAGGGACTTCGCCGCC
TACAGGCCCGCCGCCCGTCGGAGCCAGAGGCGGAGGGGGCGCCGGGGGGAGCCGGGCACCGCCCT
GCTGGCCCCGCTGGTGCTGAGCCTGGGCCTGGCGCTGGCCTGCCTTGGCCTCCTGCTGGTCGTGGT
CAGCCTGGGGAGCTGGGCAACGCTGTCTGCCCAGGAGCCTTCTCAGGAGGAGCTGACAGCAGAGG
ACCGCCGGGAGCCCCCTGAACTGAATCCCCAGACAGAGGAAAGCCAGGATGTGGTACCTTTCTTG
GAACAACTAGTCCGGCCTCGAAGAAGTGCTCCTAAAGGCCGGAAGGCGCGGCCTCGCCGAGCTAT
TGCAGCCCATTATGAGGTTCATCCTCGGCCAGGACAGGATGGAGCACAAGCAGGTGTGGATGGG
ACAGTGAGTGGCTGGGAAGAGACCAAAATCAACAGCTCCAGCCCTCTGCGCTACGACCGCCAGAT
TGGGGAATTTACAGTCATCAGGGCTGGGCTCTACTACCTGTACTGTCAGGTGCACTTTGATGAGG
GAAAGGCTGTCTACCTGAAGCTGGACTTGCTGGTGAACGGTGTGCTGGCCCTGCGCTGCCTGGAA
GAATTCTCAGCCACAGCAGCAAGCTCTCCTGGGCCCCAGCTCCGTTTGTGCCAGGTGTCTGGGCT
GTTGCCGCTGCGGCCAGGGTCTTCCCTTCGGATCCGCACCCTCCCCTGGGCTCATCTTAAGGCTGC
CCCCTTCCTAACCTACTTTGGACTCTTTCAAGTTCACTGA

Full CAR sequences with the leader sequence (LS) if needed, T2A ribosomal skip sequence (T2A), and mouse truncated CD19 (mtrCD19), suitable for use in mice LS-NbMMRm22.84-mCD28H-mCD28TM-mCD28CS-mCD3zICS-T2A-mtrCD19
(SEQ ID NO: 778) Protein sequence:
MEWTWVFLFLLSVTAGVHSQVQLQESGGGLVQPGGSLRLSCAASGRTFSNYVNYAMGWFRQFPG
KEREFVA*SISWSSVTT*YYADSVKGRFTISRDNAKNTVYLQMNSLKPEDTAVYYCAAHLAQYSDYA
YRDPHQFGAWGQGTQVTVSSIKEKHLCHTQSSPKLFWALVVVAGVLFCYGLLVTVALCVIWTNS
RRNRLLQSDYMNMTPRRPGLTRKPYQPYAPARDFAAYRPRAKFSRSAETAANLQDPNQLYNELN
LGRREEYDVLEKKRARDPEMGGKQQRRRNPQEGVYNALQKDKMAEAYSEIGTKGERRRGKGHD
GLYQGLSTATKDTYDALHMQTLAPRARAKRSGSGEGRGSLLTCGDVEENPGPMPSPLPVSFLLFL
TLVGGRPQKSLLVEVEEGGNVVLPCLPDSSPVSSEKLAWYRGNQSTPFLELSPGSPGLGLHVGSLGI
LLVIVNVSDHMGGFYLCQKRPPFKDIWQPAWTVNVEDSGEMFRWNASDVRDLDCDLRNRSSGS
HRSTSGSQLYVWAKDHPKVWGTKPVCAPRGSSLNQSLINQDLTVAPGSTLWLSCGVPPVPVAKGS
ISWTHVHPRRPNVSLLSLSLGGEHPVREMWVWGSLLLLPQATALDEGTYYCLRGNLTIERHVKVI
ARSAVWLWLLRTGGWIVPVVTLVYVIFCMVSLVAFLYCQRAFILRRKRKRMT (SEQ ID NO: 878) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAACCTGGCGGAAGCCTGAGACTGTCTTGTGCCGCTT
CTGGCAGAACCTTCAGCAACTACGTGAACTACGCCATGGGCTGGTTCAGACAGTTCCCCGGCAAA
GAGAGAGAGTTCGTCGCCAGCATCAGCTGGTCTAGCGTGACCACCTACTACGCCGACAGCGTGAA
GGGCAGATTCACCATCAGCAGAGACAACGCCAAGAACACCGTGTACCTGCAGATGAACAGCCTGA
AGCCAGAGGACACCGCCGTGTACTACTGTGCTGCTCACCTGGCTCAGTACAGCGACTACGCCTAC
AGAGATCCCCACCAGTTTGGCGCTTGGGGCCAGGGAACACAAGTGACCGTTAGCTCTATCAAGGA
GAAGCACCTGTGCCACACCCAGAGCAGCCCCAAGCTGTTCTGGGCCCTGGTGGTGGTGGCCGGCG
TGCTGTTCTGCTACGGCCTGCTGGTGACCGTGGCCCTGTGCGTGATCTGGACCAACAGCAGGAGG
AACAGGCTGCTGCAGAGCGACTACATGAACATGACCCCCAGGAGGCCCGGCCTGACCAGGAAGCC
CTACCAGCCCTACGCCCCCGCCAGGGACTTCGCCGCCTACAGGCCCAGGGCCAAGTTCAGCAGGAG
CGCCGAGACCGCCGCCAACCTGCAGGACCCCAACCAGCTGTACAACGAGCTGAACCTGGGCAGGA
GGGAGGAGTACGACGTGCTGGAGAAGAAGAGGGCCAGGGACCCCGAGATGGGCGGCAAGCAGCA
GAGGAGGAGGAACCCCCAGGAGGGCGTGTACAACGCCCTGCAGAAGGACAAGATGGCCGAGGCC
TACAGCGAGATCGGCACCAAGGGCGAGAGGAGGAGGGGCAAGGGCCACGACGGCCTGTACCAGG
GCCTGAGCACCGCCACCAAGGACACCTACGACGCCCTGCACATGCAGACCCTGGCCCCCAGGGCCA
GGGCCAAAAGGTCTGGCTCCGGTGAGGGCAGAGGAAGTCTTCTAACATGCGGTGACGTGGAGGA
GAATCCCGGCCCTATGCCATCTCCTCTGCCTGTGTCCTTCCTGCTGTTCCTGACACTCGTCGGCGG
CAGACCTCAGAAGTCTCTGCTGGTTGAGGTGGAAGAGGGCGGCAATGTGGTGCTGCCTTGTCTGC
CTGATAGCAGCCCTGTGTCCAGCGAGAAGCTGGCTTGGTACAGAGGCAACCAGAGCACCCCATTT
CTGGAACTGAGCCCTGGCTCTCCTGGACTGGGACTGCATGTTGGATCTCTGGGCATCCTGCTGGT
CATCGTGAACGTGTCCGATCACATGGGCGGCTTCTACCTGTGCCAGAAGAGGCCTCCATTCAAGG
ACATCTGGCAGCCTGCCTGGACCGTGAACGTTGAGGATAGCGGCGAGATGTTCAGATGGAACGCC
AGCGACGTGCGCGACCTGGACTGTGACCTGAGAAACAGAAGCAGCGGCAGCCACAGAAGCACCTC
TGGCTCTCAGCTGTACGTGTGGGCCAAAGATCACCCCAAAGTGTGGGGCACCAAGCCTGTGTGTG
CTCCTAGAGGCAGCAGCCTGAACCAGAGCCTGATCAACCAGGACCTGACAGTGGCTCCTGGCAGC
ACACTGTGGCTGTCTTGCGGAGTTCCTCCAGTGCCTGTGGCCAAGGGCAGCATCTCTTGGACACA
CGTGCACCCTAGAAGGCCCAACGTGTCCCTGCTGTCTCTGTCTCTCGGCGGAGAACATCCCGTGC
GCGAGATGTGGGTTTGGGGATCTCTTCTGCTGCTGCCACAGGCCACAGCTCTGGATGAGGGCACC
TACTACTGCCTGAGGGGCAACCTGACCATCGAGAGACACGTGAAAGTGATCGCCAGATCCGCCGT
GTGGCTCTGGCTTCTTAGAACAGGCGGATGGATCGTGCCCGTGGTCACCCTGGTGTACGTGATCT
TCTGCATGGTGTCCCTGGTGGCCTTCCTGTACTGCCAGAGAGCCTTCATCCTGAGAAGAAAGCGC
AAGCGGATGACCTGATGA LS-NbMMRm5.38-mCD28H-mCD28TM-mCD28CS-mCD3zICS-T2A-mtrCD19
(SEQ ID NO: 779) Protein sequence:
MEWTWVFLFLLSVTAGVHSQVQLQESGGGLVQAGGSLRLSCAASGFTDDDYDIGWFRQAPGKER
EGVS*CISSSDGST*YYADSVKGRFTISSDNAKNTVYLQMNSLKPEDTAVYYCAADFFRWDSGSYYVR
GCRHATYDYWGQGTQVTVSSIKEKHLCHTQSSPKLFWALVVVAGVLFCYGLLVTVALCVIWTNS
RRNRLLQSDYMNMTPRRPGLTRKPYQPYAPARDFAAYRPRAKFSRSAETAANLQDPNQLYNELN
LGRREEYDVLEKKRARDPEMGGKQQRRRNPQEGVYNALQKDKMAEAYSEIGTKGERRRGKGHD
GLYQGLSTATKDTYDALHMQTLAPRARAKRSGSGEGRGSLLTCGDVEENPGPMPSPLPVSFLLFL
TLVGGRPQKSLLVEVEEGGNVVLPCLPDSSPVSSEKLAWYRGNQSTPFLELSPGSPGLGLHVGSLGI
LLVIVNVSDHMGGFYLCQKRPPFKDIWQPAWTVNVEDSGEMFRWNASDVRDLDCDLRNRSSGS

AMINO ACID AND NUCLEIC ACID SEQUENCES

HRSTSGSQLYVWAKDHPKVWGTKPVCAPRGSSLNQSLINQDLTVAPGSTLWLSCGVPPVPVAKGS
ISWTHVHPRRPNVSLLSLSLGGEHPVREMWVWGSLLLLPQATALDEGTYYCLRGNLTIERHVKVI
ARSAVWLWLLRTGGWIVPVVTLVYVIFCMVSLVAFLYCQRAFILRRKRKRMT (SEQ ID NO: 879) DNA sequence:
ATGGAGTGGACCTGGGTGTTCCTGTTCCTGCTGAGCGTGACCGCCGGCGTGCACAGCCAGGTTCA
GCTGCAAGAGTCTGGCGGAGGACTGGTTCAAGCTGGCGGAAGCCTGAGACTGTCTTGTGCCGCTT
CTGGCTTCACCGACGACGACTACGATATCGGCTGGTTCAGACAGGCCCCTGGCAAAGAGAGAGAG
GGCGTCAGCTGTATCAGCAGCTCTGACGGCTCTACCTACTACGCCGACAGCGTGAAGGGCAGATT
CACCATCAGCAGCGACAACGCCAAGAACACCGTGTACCTGCAGATGAACTCTCTGAAGCCCGAGG
ACACCGCCGTGTACTACTGTGCCGCCGACTTCTTCAGATGGGACAGCGGCAGCTACTACGTGCGG
GGATGTAGACACGCCACCTACGATTACTGGGGCCAGGGCACACAAGTGACCGTGTCATCTATCAA
GGAGAAGCACCTGTGCCACACCCAGAGCAGCCCCAAGCTGTTCTGGGCCCTGGTGGTGGTGGCCG
GCGTGCTGTTCTGCTACGGCCTGCTGGTGACCGTGGCCCTGTGCGTGATCTGGACCAACAGCAGG
AGGAACAGGCTGCTGCAGAGCGACTACATGAACATGACCCCCAGGAGGCCCGGCCTGACCAGGAA
GCCCTACCAGCCCTACGCCCCCGCCAGGGACTTCGCCGCCTACAGGCCCAGGGCCAAGTTCAGCAG
GAGCGCCGAGACCGCCGCCAACCTGCAGGACCCCAACCAGCTGTACAACGAGCTGAACCTGGGCA
GGAGGGAGGAGTACGACGTGCTGGAGAAGAAGAGGGCCAGGGACCCCGAGATGGGCGGCAAGCA
GCAGAGGAGGAGGAACCCCCAGGAGGGCGTGTACAACGCCCTGCAGAAGGACAAGATGGCCGAG
GCCTACAGCGAGATCGGCACCAAGGGCGAGAGGAGGAGGGGCAAGGGCCACGACGGCCTGTACCA
GGGCCTGAGCACCGCCACCAAGGACACCTACGACGCCCTGCACATGCAGACCCTGGCCCCCAGGGC
CAGGGCCAAAAGGTCTGGCTCCGGTGAGGGCAGAGGAAGTCTTCTAACATGCGGTGACGTGGAG
GAGAATCCCGGCCCTATGCCATCTCCTCTGCCTGTGTCCTTCCTGCTGTTCCTGACACTCGTCGGC
GGCAGACCTCAGAAGTCTCTGCTGGTTGAGGTGGAAGAGGGCGGCAATGTGGTGCTGCCTTGTCT
GCCTGATAGCAGCCCTGTGTCCAGCGAGAAGCTGGCTTGGTACAGAGGCAACCAGAGCACCCCAT
TTCTGGAACTGAGCCCTGGCTCTCCTGGACTGGGACTGCATGTTGGATCTCTGGGCATCCTGCTG
GTCATCGTGAACGTGTCCGATCACATGGGCGGCTTCTACCTGTGCCAGAAGAGGCCTCCATTCAA
GGACATCTGGCAGCCTGCCTGGACCGTGAACGTTGAGGATAGCGGCGAGATGTTCAGATGGAACG
CCAGCGACGTGCGCGACCTGGACTGTGACCTGAGAAACAGAAGCAGCGGCAGCCACAGAAGCACC
TCTGGCTCTCAGCTGTACGTGTGGGCCAAAGATCACCCCAAAGTGTGGGGCACCAAGCCTGTGTG
TGCTCCTAGAGGCAGCAGCCTGAACCAGAGCCTGATCAACCAGGACCTGACAGTGGCTCCTGGCA
GCACACTGTGGCTGTCTTGCGGAGTTCCTCCAGTGCCTGTGGCCAAGGGCAGCATCTCTTGGACA
CACGTGCACCCTAGAAGGCCCAACGTGTCCCTGCTGTCTCTGTCTCTCGGCGGAGAACATCCCGT
GCGCGAGATGTGGGTTTGGGGATCTCTTCTGCTGCTGCCACAGGCCACAGCTCTGGATGAGGGCA
CCTACTACTGCCTGAGGGGCAACCTGACCATCGAGAGACACGTGAAAGTGATCGCCAGATCCGCC
GTGTGGCTCTGGCTTCTTAGAACAGGCGGATGGATCGTGCCCGTGGTCACCCTGGTGTACGTGAT
CTTCTGCATGGTGTCCCTGGTGGCCTTCCTGTACTGCCAGAGAGCCTTCATCCTGAGAAGAAAGC
GCAAGCGGATGACCTGATGA LS-scFvP4A8VHVL-mCD28H-mCD28TM-mCD28CS-mCD3zICS-T2A-mtrCD19
(SEQ ID NO: 780) Protein sequence:
MEWTWVFLFLLSVTAGVHSQVQLQQSGPEVVRPGVSVKISCKGSGYTFTDYGMHWVKQSHAKSL
EWIGVISTYNGYTNYNQKFKGKATMTVDKSSSTAYMELARLTSEDSAIYYCARAYYGNLYYAMDY
WGQGTSVTVSSGGGGSGGGGSGGGGSDIVLTQSPASLAVSLGQRATISCRASKSVSTSSYSYMHWY
QQKPGQPPKLLIKYASNLESGVPARFSGSGSGTDFILNIHPVEEEDAATYYCQHSRELPFTFGSGTK
LEIKIKEKHLCHTQSSPKLFWALVVVAGVLFCYGLLVTVALCVIWTNSRRNRLLQSDYMNMTPRR
PGLTRKPYQPYAPARDFAAYRPRAKFSRSAETAANLQDPNQLYNELNLGRREEYDVLEKKRARD
PEMGGKQQRRRNPQEGVYNALQKDKMAEAYSEIGTKGERRRGKGHDGLYQGLSTATKDTYDAL
HMQTLAPRARAKRSGSGEGRGSLLTCGDVEENPGPMPSPLPVSFLLFLTLVGGRPQKSLLVEVEEG
GNVVLPCLPDSSPVSSEKLAWYRGNQSTPFLELSPGSPGLGLHVGSLGILLVIVNVSDHMGGFYLCQ
KRPPFKDIWQPAWTVNVEDSGEMFRWNASDVRDLDCDLRNRSSGSHRSTSGSQLYVWAKDHPK
VWGTKPVCAPRGSSLNQSLINQDLTVAPGSTLWLSCGVPPVPVAKGSISWTHVHPRRPNVSLLSLS
LGGEHPVREMWVWGSLLLLPQATALDEGTYYCLRGNLTIERHVKVIARSAVWLWLLRTGGWIVP
VVTLVYVIFCMVSLVAFLYCQRAFILRRKRKRMT (SEQ ID NO: 880) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATGCACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAGCAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAATCAAGGAGAAGCACCTGTGCCACACCCAGAGCAGCCCCAAGCT
GTTCTGGGCCCTGGTGGTGGTGGCCGGCGTGCTGTTCTGCTACGGCCTGCTGGTGACCGTGGCCC
TGTGCGTGATCTGGACCAACAGCAGGAGGAACAGGCTGCTGCAGAGCGACTACATGAACATGACC
CCCAGGAGGCCCGGCCTGACCAGGAAGCCCTACCAGCCCTACGCCCCCGCCAGGGACTTCGCCGCC
TACAGGCCCAGGGCCAAGTTCAGCAGGAGCGCCGAGACCGCCGCCAACCTGCAGGACCCCAACCA
GCTGTACAACGAGCTGAACCTGGGCAGGAGGGAGGAGTACGACGTGCTGGAGAAGAAGAGGGCC
AGGGACCCCGAGATGGGCGGCAAGCAGCAGAGGAGGAGGAACCCCCAGGAGGGCGTGTACAACG
CCCTGCAGAAGGACAAGATGGCCGAGGCCTACAGCGAGATCGGCACCAAGGGCGAGAGGAGGAG
GGGCAAGGGCCACGACGGCCTGTACCAGGGCCTGAGCACCGCCACCAAGGACACCTACGACGCCC
TGCACATGCAGACCCTGGCCCCCAGGGCCAGGGCCAAAAGGTCTGGCTCCGGTGAGGGCAGAGGA APPENDIX-continued

AMINO ACID AND NUCLEIC ACID SEQUENCES

AGTCTTCTAACATGCGGTGACGTGGAGGAGAATCCCGGCCCTATGCCATCTCCTCTGCCTGTGTC
CTTCCTGCTGTTCCTGACACTCGTCGGCGGCAGACCTCAGAAGTCTCTGCTGGTTGAGGTGGAAG
AGGGCGGCAATGTGGTGCTGCCTTGTCTGCCTGATAGCAGCCCTGTGTCCAGCGAGAAGCTGGCT
TGGTACAGAGGCAACCAGAGCACCCCATTTCTGGAACTGAGCCCTGGCTCTCCTGGACTGGGACT
GCATGTTGGATCTCTGGGCATCCTGCTGGTCATCGTGAACGTGTCCGATCACATGGGCGGCTTCT
ACCTGTGCCAGAAGAGGCCTCCATTCAAGGACATCTGGCAGCCTGCCTGGACCGTGAACGTTGAG
GATAGCGGCGAGATGTTCAGATGGAACGCCAGCGACGTGCGCGACCTGGACTGTGACCTGAGAA
ACAGAAGCAGCGGCAGCCACAGAAGCACCTCTGGCTCTCAGCTGTACGTGTGGGCCAAAGATCAC
CCCAAAGTGTGGGGCACCAAGCCTGTGTGTGCTCCTAGAGGCAGCAGCCTGAACCAGAGCCTGAT
CAACCAGGACCTGACAGTGGCTCCTGGCAGCACACTGTGGCTGTCTTGCGGAGTTCCTCCAGTGC
CTGTGGCCAAGGGCAGCATCTCTTGGACACACGTGCACCCTAGAAGGCCCAACGTGTCCCTGCTG
TCTCTGTCTCTCGGCGGAGAACATCCCGTGCGCGAGATGTGGGTTTGGGGATCTCTTCTGCTGCT
GCCACAGGCCACAGCTCTGGATGAGGGCACCTACTACTGCCTGAGGGGCAACCTGACCATCGAGA
GACACGTGAAAGTGATCGCCAGATCCGCCGTGTGGCTCTGGCTTCTTAGAACAGGCGGATGGATC
GTGCCCGTGGTCACCCTGGTGTACGTGATCTTCTGCATGGTGTCCCTGGTGGCCTTCCTGTACTG
CCAGAGAGCCTTCATCCTGAGAAGAAAGCGCAAGCGGATGACCTGATGA

LS-scFvP4A8VLVH-mCD28H-mCD28TM-mCD28CS-mCD3zICS-T2A-mtrCD19
(SEQ ID NO: 781) Protein sequence:
MEWTWVFLFLLSVTAGVHSDIVLTQSPASLAVSLGQRATISCRASKSVSTSSYSYMHWYQQKPGQ
PPKLLIKY*ASNLES*GVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGMHWVKQSHAKSLEWIG*VISTY
NGYTNYNQKFKG*KATMTVDKSSSTAYMELARLTSEDSAIYYCARAYYGNLYYAMDYWGQGTSVT
VSSIKEKHLCHTQSSPKLFWALVVVAGVLFCYGLLVTVALCVIWTNSRRNRLLQSDYMNMTPRRP
GLTRKPYQPYAPARDFAAYRPRAKFSRSAETAANLQDPNQLYNELNLGRREEYDVLEKKRARDP
EMGGKQQRRRNPQEGVYNALQKDKMAEAYSEIGTKGERRRGKGHDGLYQGLSTATKDTYDALH
MQTLAPRARAKRSGSGEGRGSLLTCGDVEENPGPMPSPLPVSFLLFLTLVGGRPQKSLLVEVEEGG
NVVLPCLPDSSPVSSEKLAWYRGNQSTPFLELSPGSPGLGLHVGSLGILLVIVNVSDHMGGFYLCQK
RPPFKDIWQPAWTVNVEDSGEMFRWNASDVRDLDCDLRNRSSGSHRSTSGSQLYVWAKDHPKV
WGTKPVCAPRGSSLNQSLINQDLTVAPGSTLWLSCGVPPVPVAKGSISWTHVHPRRPNVSLLSLSL
GGEHPVREMWVWGSLLLLPQATALDEGTYYCLRGNLTIERHVKVIARSAVWLWLLRTGGWIVPV
VTLVYVIFCMVSLVAFLYCQRAFILRRKRKRMT (SEQ ID NO: 881) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAGCAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATGCACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA
CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAATCAAGGAGAAGCACCTGTGCCACACCCAGAGCAGCCCCAAGC
TGTTCTGGGCCCTGGTGGTGGTGGCCGGCGTGCTGTTCTGCTACGGCCTGCTGGTGACCGTGGCC
CTGTGCGTGATCTGGACCAACAGCAGGAGGAACAGGCTGCTGCAGAGCGACTACATGAACATGAC
CCCCAGGAGGCCCGGCCTGACCAGGAAGCCCTACCAGCCCTACGCCCCCGCCAGGGACTTCGCCGC
CTACAGGCCCAGGGCCAAGTTCAGCAGGAGCGCCGAGACCGCCGCCAACCTGCAGGACCCCAACC
AGCTGTACAACGAGCTGAACCTGGGCAGGAGGGAGGAGTACGACGTGCTGGAGAAGAAGAGGGC
CAGGGACCCCGAGATGGGCGGCAAGCAGCAGAGGAGGAGGAACCCCCAGGAGGGCGTGTACAAC
GCCCTGCAGAAGGACAAGATGGCCGAGGCCTACAGCGAGATCGGCACCAAGGGCGAGAGGAGGA
GGGGCAAGGGCCACGACGGCCTGTACCAGGGCCTGAGCACCGCCACCAAGGACACCTACGACGCC
CTGCACATGCAGACCCTGGCCCCCAGGGCCAGGGCCAAAAGGTCTGGCTCCGGTGAGGGCAGAGG
AAGTCTTCTAACATGCGGTGACGTGGAGGAGAATCCCGGCCCTATGCCATCTCCTCTGCCTGTGT
CCTTCCTGCTGTTCCTGACACTCGTCGGCGGCAGACCTCAGAAGTCTCTGCTGGTTGAGGTGGAA
GAGGGCGGCAATGTGGTGCTGCCTTGTCTGCCTGATAGCAGCCCTGTGTCCAGCGAGAAGCTGGC
TTGGTACAGAGGCAACCAGAGCACCCCATTTCTGGAACTGAGCCCTGGCTCTCCTGGACTGGGAC
TGCATGTTGGATCTCTGGGCATCCTGCTGGTCATCGTGAACGTGTCCGATCACATGGGCGGCTTC
TACCTGTGCCAGAAGAGGCCTCCATTCAAGGACATCTGGCAGCCTGCCTGGACCGTGAACGTTGA
GGATAGCGGCGAGATGTTCAGATGGAACGCCAGCGACGTGCGCGACCTGGACTGTGACCTGAGAA
ACAGAAGCAGCGGCAGCCACAGAAGCACCTCTGGCTCTCAGCTGTACGTGTGGGCCAAAGATCAC
CCCAAAGTGTGGGGCACCAAGCCTGTGTGTGCTCCTAGAGGCAGCAGCCTGAACCAGAGCCTGAT
CAACCAGGACCTGACAGTGGCTCCTGGCAGCACACTGTGGCTGTCTTGCGGAGTTCCTCCAGTGC
CTGTGGCCAAGGGCAGCATCTCTTGGACACACGTGCACCCTAGAAGGCCCAACGTGTCCCTGCTG
TCTCTGTCTCTCGGCGGAGAACATCCCGTGCGCGAGATGTGGGTTTGGGGATCTCTTCTGCTGCT
GCCACAGGCCACAGCTCTGGATGAGGGCACCTACTACTGCCTGAGGGGCAACCTGACCATCGAGA
GACACGTGAAAGTGATCGCCAGATCCGCCGTGTGGCTCTGGCTTCTTAGAACAGGCGGATGGATC
GTGCCCGTGGTCACCCTGGTGTACGTGATCTTCTGCATGGTGTCCCTGGTGGCCTTCCTGTACTG
CCAGAGAGCCTTCATCCTGAGAAGAAAGCGCAAGCGGATGACCTGATGA LS-scFvP3GSVHVL-mCD28H-mCD28TM-mCD28CS-mCD3zICS-T2A-mtrCD19
(SEQ ID NO: 782) Protein sequence:
MEWTWVFLFLLSVTAGVHSQVQLQQSGPEVVRPGVSVKISCKGSGYTFTDYGIHWVKQSHAKSLE
WIG*VISTYNGYTNYNQKFKG*KATMTVDKSSSTAYMELARLTSEDSAIYYCARAYYGNLYYAMDY
WGQGTSVTVSSGGGGSGGGGSGGGGSDIVLTQSPASLAVSLGQRATISCRANKSVSTSSYSYMHWY

AMINO ACID AND NUCLEIC ACID SEQUENCES

QQKPGQPPKLLIKY*ASNLES*GVPARFSGSGSGTDFILNIHPVEEEDAATYYCQHSRELPFTFGSGTK
LEIKIKEKHLCHTQSSPKLFWALVVVAGVLFCYGLLVTVALCVIWTNSRRNRLLQSDYMNMTPRR
PGLTRKPYQPYAPARDFAAYRPRAKFSRSAETAANLQDPNQLYNELNLGRREEYDVLEKKRARD
PEMGGKQQRRRNPQEGVYNALQKDKMAEAYSEIGTKGERRRGKGHDGLYQGLSTATKDTYDAL
HMQTLAPRARAKRSGSGEGRGSLLTCGDVEENPGPMPSPLPVSFLLFLTLVGGRPQKSLLVEVEEG
GNVVLPCLPDSSPVSSEKLAWYRGNQSTPFLELSPGSPGLGLHVGSLGILLVIVNVSDHMGGFYLCQ
KRPPFKDIWQPAWTVNVEDSGEMFRWNASDVRDLDCDLRNRSSGSHRSTSGSQLYVWAKDHPK
VWGTKPVCAPRGSSLNQSLINQDLTVAPGSTLWLSCGVPPVPVAKGSISWTHVHPRRPNVSLLSLS
LGGEHPVREMWVWGSLLLLPQATALDEGTYYCLRGNLTIERHVKVIARSAVWLWLLRTGGWIVP
VVTLVYVIFCMVSLVAFLYCQRAFILRRKRKRMT (SEQ ID NO: 882) DNA sequence:
ATGGAGTGGACCTGGGTGTTCCTGTTCCTGCTGAGCGTGACCGCCGGCGTGCACAGCCAGGTCCA
GCTGCAGCAGTCTGGGCCTGAGGTGGTGAGGCCTGGGGTCTCAGTGAAGATTTCCTGCAAGGGTT
CCGGCTACACATTCACTGATTATGGTATACACTGGGTGAAGCAGAGTCATGCAAAGAGTCTAGA
GTGGATTGGAGTTATTAGTACTTACAATGGTTATACAAACTACAACCAGAAGTTTAAGGGCAAG
GCCACAATGACTGTAGACAAATCCTCCAGCACAGCCTATATGGAACTTGCCAGATTGACATCTGA
GGATTCTGCCATCTATTACTGTGCAAGAGCCTACTATGGTAACCTTTACTATGCTATGGACTACT
GGGGTCAAGGAACCTCAGTCACCGTCTCCTCAGGTGGTGGTGGTTCTGGCGGCGGCGGCTCCGGT
GGTGGTGGTTCCGACATTGTGCTGACACAGTCTCCTGCTTCCTTAGCTGTATCTCTGGGGCAGAG
GGCCACCATCTCATGCAGGGCCAACAAAAGTGTCAGTACATCTAGCTATAGTTATATGCACTGGT
ACCAACAGAAACCAGGACAGCCACCCAAACTCCTCATCAAGTATGCATCCAACCTAGAATCTGGG
GTCCCTGCCAGGTTCAGTGGCAGTGGGTCTGGGACAGACTTCATCCTCAACATCCATCCAGTGGA
GGAGGAGGATGCTGCAACCTATTACTGTCAGCACAGTAGGGAGCTTCCATTCACGTTCGGCTCGG
GGACAAAGTTGGAAATAAAAATCAAGGAGAAGCACCTGTGCCACACCCAGAGCAGCCCCAAGCT
GTTCTGGGCCCTGGTGGTGGTGGCCGGCGTGCTGTTCTGCTACGGCCTGCTGGTGACCGTGGCCC
TGTGCGTGATCTGGACCAACAGCAGGAGGAACAGGCTGCTGCAGAGCGACTACATGAACATGACC
CCCAGGAGGCCCGGCCTGACCAGGAAGCCCTACCAGCCCTACGCCCCCGCCAGGGACTTCGCCGCC
TACAGGCCCAGGGCCAAGTTCAGCAGGAGCGCCGAGACCGCCGCCAACCTGCAGGACCCCAACCA
GCTGTACAACGAGCTGAACCTGGGCAGGAGGGAGGAGTACGACGTGCTGGAGAAGAAGAGGGCC
AGGGACCCCGAGATGGGCGGCAAGCAGCAGAGGAGGAGGAACCCCCAGGAGGGCGTGTACAACG
CCCTGCAGAAGGACAAGATGGCCGAGGCCTACAGCGAGATCGGCACCAAGGGCGAGAGGAGGAG
GGGCAAGGGCCACGACGGCCTGTACCAGGGCCTGAGCACCGCCACCAAGGACACCTACGACGCCC
TGCACATGCAGACCCTGGCCCCCAGGGCCAGGGCCAAAAGGTCTGGCTCCGGTGAGGGCAGAGGA
AGTCTTCTAACATGCGGTGACGTGGAGGAGAATCCCGGCCCTATGCCATCTCCTCTGCCTGTGTC
CTTCCTGCTGTTCCTGACACTCGTCGGCGGCAGACCTCAGAAGTCTCTGCTGGTTGAGGTGGAAG
AGGGCGGCAATGTGGTGCTGCCTTGTCTGCCTGATAGCAGCCCTGTGTCCAGCGAGAAGCTGGCT
TGGTACAGAGGCAACCAGAGCACCCCATTTCTGGAACTGAGCCCTGGCTCTCCTGGACTGGGACT
GCATGTTGGATCTCTGGGCATCCTGCTGGTCATCGTGAACGTGTCCGATCACATGGGCGGCTTCT
ACCTGTGCCAGAAGAGGCCTCCATTCAAGGACATCTGGCAGCCTGCCTGGACCGTGAACGTTGAG
GATAGCGGCGAGATGTTCAGATGGAACGCCAGCGACGTGCGCGACCTGGACTGTGACCTGAGAA
ACAGAAGCAGCGGCAGCCACAGAAGCACCTCTGGCTCTCAGCTGTACGTGTGGGCCAAAGATCAC
CCCAAAGTGTGGGGCACCAAGCCTGTGTGTGCTCCTAGAGGCAGCAGCCTGAACCAGAGCCTGAT
CAACCAGGACCTGACAGTGGCTCCTGGCAGCACACTGTGGCTGTCTTGCGGAGTTCCTCCAGTGC
CTGTGGCCAAGGGCAGCATCTCTTGGACACACGTGCACCCTAGAAGGCCCAACGTGTCCCTGCTG
TCTCTGTCTCTCGGCGGAGAACATCCCGTGCGCGAGATGTGGGTTTGGGGATCTCTTCTGCTGCT
GCCACAGGCCACAGCTCTGGATGAGGGCACCTACTACTGCCTGAGGGGCAACCTGACCATCGAGA
GACACGTGAAAGTGATCGCCAGATCCGCCGTGTGGCTCTGGCTTCTTAGAACAGGCGGATGGATC
GTGCCCGTGGTCACCCTGGTGTACGTGATCTTCTGCATGGTGTCCCTGGTGGCCTTCCTGTACTG
CCAGAGAGCCTTCATCCTGAGAAGAAAGCGCAAGCGGATGACCTGATGA LS-scFvP3GSVLVH-mCD28H-mCD28TM-mCD28CS-mCD3zICS-T2A-mtrCD19
(SEQ ID NO: 783) Protein sequence:
MEWTWVFLFLLSVTAGVHSDIVLTQSPASLAVSLGQRATISCRANKSVSTSSYSYMHWYQQKPGQ
PPKLLIKYASNLESGVPARFSGSGSGTDFILNIHPVEEEDAATYYCQHSRELPFTFGSGTKLEIKGGG
GSGGGGSGGGGSQVQLQQSGPEVVRPGVSVKISCKGSGYTFTDYGIHWVKQSHAKSLEWIG**VISTY
NGYTNYNQKFKGKATMTVDKSSSTAYMELARLTSEDSAIYYCARAYYGNLYYAMDY**WGQGTSVT
VSSIKEKHLCHTQSSPKLFWALVVVAGVLFCYGLLVTVALCVIWTNSRRNRLLQSDYMNMTPRRP
GLTRKPYQPYAPARDFAAYRPRAKFSRSAETAANLQDPNQLYNELNLGRREEYDVLEKKRARDP
EMGGKQQRRRNPQEGVYNALQKDKMAEAYSEIGTKGERRRGKGHDGLYQGLSTATKDTYDALH
MQTLAPRARAKRSGSGEGRGSLLTCGDVEENPGPMPSPLPVSFLLFLTLVGGRPQKSLLVEVEEGG
NVVLPCLPDSSPVSSEKLAWYRGNQSTPFLELSPGSPGLGLHVGSLGILLVIVNVSDHMGGFYLCQK
RPPFKDIWQPAWTVNVEDSGEMFRWNASDVRDLDCDLRNRSSGSHRSTSGSQLYVWAKDHPKV
WGTKPVCAPRGSSLNQSLINQDLTVAPGSTLWLSCGVPPVPVAKGSISWTHVHPRRPNVSLLSLSL
GGEHPVREMWVWGSLLLLPQATALDEGTYYCLRGNLTIERHVKVIARSAVWLWLLRTGGWIVPV
VTLVYVIFCMVSLVAFLYCQRAFILRRKRKRMT (SEQ ID NO: 883) DNA sequence:
ATGGAGTGGACCTGGGTGTTCCTGTTCCTGCTGAGCGTGACCGCCGGCGTGCACAGCGACATTGT
GCTGACACAGTCTCCTGCTTCCTTAGCTGTATCTCTGGGGCAGAGGGCCACCATCTCATGCAGGG
CCAACAAAAGTGTCAGTACATCTAGCTATAGTTATATGCACTGGTACCAACAGAAACCAGGACA
GCCACCCAAACTCCTCATCAAGTATGCATCCAACCTAGAATCTGGGGTCCCTGCCAGGTTCAGTG
GCAGTGGGTCTGGGACAGACTTCATCCTCAACATCCATCCAGTGGAGGAGGAGGATGCTGCAACC
TATTACTGTCAGCACAGTAGGGAGCTTCCATTCACGTTCGGCTCGGGGACAAAGTTGGAAATAA
AAGGTGGTGGTGGTTCTGGCGGCGGCGGCTCCGGTGGTGGTGGTTCCCAGGTCCAGCTGCAGCAG
TCTGGGCCTGAGGTGGTGAGGCCTGGGGTCTCAGTGAAGATTTCCTGCAAGGGTTCCGGCTACAC
ATTCACTGATTATGGTATACACTGGGTGAAGCAGAGTCATGCAAAGAGTCTAGAGTGGATTGGA
GTTATTAGTACTTACAATGGTTATACAAACTACAACCAGAAGTTTAAGGGCAAGGCCACAATGA

AMINO ACID AND NUCLEIC ACID SEQUENCES

CTGTAGACAAATCCTCCAGCACAGCCTATATGGAACTTGCCAGATTGACATCTGAGGATTCTGCC
ATCTATTACTGTGCAAGAGCCTACTATGGTAACCTTTACTATGCTATGGACTACTGGGGTCAAGG
AACCTCAGTCACCGTCTCCTCAATCAAGGAGAAGCACCTGTGCCACACCCAGAGCAGCCCCAAGC
TGTTCTGGGCCCTGGTGGTGGTGGCCGGCGTGCTGTTCTGCTACGGCCTGCTGGTGACCGTGGCC
CTGTGCGTGATCTGGACCAACAGCAGGAGGAACAGGCTGCTGCAGAGCGACTACATGAACATGAC
CCCCAGGAGGCCCGGCCTGACCAGGAAGCCCTACCAGCCCTACGCCCCCGCCAGGGACTTCGCCGC
CTACAGGCCCAGGGCCAAGTTCAGCAGGAGCGCCGAGACCGCCGCCAACCTGCAGGACCCCAACC
AGCTGTACAACGAGCTGAACCTGGGCAGGAGGGAGGAGTACGACGTGCTGGAGAAGAAGAGGGC
CAGGGACCCCGAGATGGGCGGCAAGCAGCAGAGGAGGAGGAACCCCCAGGAGGGCGTGTACAAC
GCCCTGCAGAAGGACAAGATGGCCGAGGCCTACAGCGAGATCGGCACCAAGGGCGAGAGGAGGA
GGGGCAAGGGCCACGACGGCCTGTACCAGGGCCTGAGCACCGCCACCAAGGACACCTACGACGCC
CTGCACATGCAGACCCTGGCCCCCAGGGCCAGGGCCAAAAGGTCTGGCTCCGGTGAGGGCAGAGG
AAGTCTTCTAACATGCGGTGACGTGGAGGAGAATCCCGGCCCTATGCCATCTCCTCTGCCTGTGT
CCTTCCTGCTGTTCCTGACACTCGTCGGCGGCAGACCTCAGAAGTCTCTGCTGGTTGAGGTGGAA
GAGGGCGGCAATGTGGTGCTGCCTTGTCTGCCTGATAGCAGCCCTGTGTCCAGCGAGAAGCTGGC
TTGGTACAGAGGCAACCAGAGCACCCCATTTCTGGAACTGAGCCCTGGCTCTCCTGGACTGGGAC
TGCATGTTGGATCTCTGGGCATCCTGCTGGTCATCGTGAACGTGTCCGATCACATGGGCGGCTTC
TACCTGTGCCAGAAGAGGCCTCCATTCAAGGACATCTGGCAGCCTGCCTGGACCGTGAACGTTGA
GGATAGCGGCGAGATGTTCAGATGGAACGCCAGCGACGTGCGCGACCTGGACTGTGACCTGAGAA
ACAGAAGCAGCGGCAGCCACAGAAGCACCTCTGGCTCTCAGCTGTACGTGTGGGCCAAAGATCAC
CCCAAAGTGTGGGGCACCAAGCCTGTGTGTGCTCCTAGAGGCAGCAGCCTGAACCAGAGCCTGAT
CAACCAGGACCTGACAGTGGCTCCTGGCAGCACACTGTGGCTGTCTTGCGGAGTTCCTCCAGTGC
CTGTGGCCAAGGGCAGCATCTCTTGGACACACGTGCACCCTAGAAGGCCCAACGTGTCCCTGCTG
TCTCTGTCTCTCGGCGGAGAACATCCCGTGCGCGAGATGTGGGTTTGGGGATCTCTTCTGCTGCT
GCCACAGGCCACAGCTCTGGATGAGGGCACCTACTACTGCCTGAGGGGCAACCTGACCATCGAGA
GACACGTGAAAGTGATCGCCAGATCCGCCGTGTGGCTCTGGCTTCTTAGAACAGGCGGATGGATC
GTGCCCGTGGTCACCCTGGTGTACGTGATCTTCTGCATGGTGTCCCTGGTGGCCTTCCTGTACTG
CCAGAGAGCCTTCATCCTGAGAAGAAAGCGCAAGCGGATGACCTGATGA mCD3zICS-mCD28CS-mTWEAK-T2A-mtrCD19
(SEQ ID NO: 784) Protein sequence:
RAKFSRSAETAANLQDPNQLYNELNLGRREEYDVLEKKRARDPEMGGKQQRRRNPQEGVYNAL
QKDKMAEAYSEIGTKGERRRGKGHDGLYQGLSTATKDTYDALHMQTLAPRNSRRNRLLQSDYM
NMTPRRPGLTRKPYQPYAPARDFAAYRPAARRSQRRRGRRGEPGTALLAPLVLSLGLALACLGLL
LVVVSLGSWATLSAQEPSQEELTAEDRREPPELNPQTEESQDVVPFLEQLVRPRRSAPKGRKARP
RRAIAAHYEVHPRPGQDGAQAGVDGTVSGWEETKINSSSPLRYDRQIGEFTVIRAGLYYLYCQVHF
DEGKAVYLKLDLLVNGVLALRCLEEFSATAASSPGPQLRLCQVSGLLPLRPGSSLRIRTLPWAHLK
AAPFLTYFGLFQVHARAKRSGSGEGRGSLLTCGDVEENPGPMPSPLPVSFLLFLTLVGGRPQKSLL
VEVEEGGNVVLPCLPDSSPVSSEKLAWYRGNQSTPFLELSPGSPGLGLHVGSLGILLVIVNVSDHMG
GFYLCQKRPPFKDIWQPAWTVNVEDSGEMFRWNASDVRDLDCDLRNRSSGSHRSTSGSQLYVW
AKDHPKVWGTKPVCAPRGSSLNQSLINQDLTVAPGSTLWLSCGVPPVPVAKGSISWTHVHPRRP
NVSLLSLSLGGEHPVREMWVWGSLLLLPQATALDEGTYYCLRGNLTIERHVKVIARSAVWLWLL
RTGGWIVPVVTLVYVIFCMVSLVAFLYCQRAFILRRKRKRMT (SEQ ID NO: 884) DNA sequence:
AGGGCCAAGTTCAGCAGGAGCGCCGAGACCGCCGCCAACCTGCAGGACCCCAACCAGCTGTACAA
CGAGCTGAACCTGGGCAGGAGGGAGGAGTACGACGTGCTGGAGAAGAAGAGGGCCAGGGACCCC
GAGATGGGCGGCAAGCAGCAGAGGAGGAGGAACCCCCAGGAGGGCGTGTACAACGCCCTGCAGA
AGGACAAGATGGCCGAGGCCTACAGCGAGATCGGCACCAAGGGCGAGAGGAGGAGGGGCAAGGG
CCACGACGGCCTGTACCAGGGCCTGAGCACCGCCACCAAGGACACCTACGACGCCCTGCACATGC
AGACCCTGGCCCCCAGGAACAGCAGGAGGAACAGGCTGCTGCAGAGCGACTACATGAACATGACC
CCCAGGAGGCCCGGCCTGACCAGGAAGCCCTACCAGCCCTACGCCCCCGCCAGGGACTTCGCCGCC
TACAGGCCCGCCGCCCGTCGGAGCCAGAGGCGGAGGGGGCGCCGGGGGGAGCCGGGCACCGCCCT
GCTGGCCCCGCTGGTGCTGAGCCTGGGCCTGGCGCTGGCCTGCCTTGGCCTCCTGCTGGTCGTGGT
CAGCCTGGGGAGCTGGGCAACGCTGTCTGCCCAGGAGCCTTCTCAGGAGGAGCTGACAGCAGAGG
ACCGCCGGGAGCCCCCTGAACTGAATCCCCAGACAGAGGAAAGCCAGGATGTGGTACCTTTCTTG
GAACAACTAGTCCGGCCTCGAAGAAGTGCTCCTAAAGGCCGGAAGGCGCGGCCTCGCCGAGCTAT
TGCAGCCCATTATGAGGTTCATCCTCGGCCAGGACAGGATGGAGCACAAGCAGGTGTGGATGGG
ACAGTGAGTGGCTGGGAAGAGACCAAAATCAACAGCTCCAGCCCTCTGCGCTACGACCGCCAGAT
TGGGGAATTTACAGTCATCAGGGCTGGGCTCTACTACCTGTACTGTCAGGTGCACTTTGATGAGG
GAAAGGCTGTCTACCTGAAGCTGGACTTGCTGGTGAACGGTGTGCTGGCCCTGCGCTGCCTGGAA
GAATTCTCAGCCACAGCAGCAAGCTCTCCTGGGCCCCAGCTCCGTTTGTGCCAGGTGTCTGGGCT
GTTGCCGCTGCGGCCAGGGTCTTCCCTTCGGATCCGCACCCTCCCCTGGGCTCATCTTAAGGCTGC
CCCCTTCCTAACCTACTTTGGACTCTTTCAAGTTCACTGAGCCAGGGCCAAAAGGTCTGGCTCCG
GTGAGGGCAGAGGAAGTCTTCTAACATGCGGTGACGTGGAGGAGAATCCCGGCCCTATGCCATCT
CCTCTGCCTGTGTCCTTCCTGCTGTTCCTGACACTCGTCGGCGGCAGACCTCAGAAGTCTCTGCTG
GTTGAGGTGGAAGAGGGCGGCAATGTGGTGCTGCCTTGTCTGCCTGATAGCAGCCCTGTGTCCAG
CGAGAAGCTGGCTTGGTACAGAGGCAACCAGAGCACCCCATTTCTGGAACTGAGCCCTGGCTCTC
CTGGACTGGGACTGCATGTTGGATCTCTGGGCATCCTGCTGGTCATCGTGAACGTGTCCGATCAC
ATGGGCGGCTTCTACCTGTGCCAGAAGAGGCCTCCATTCAAGGACATCTGGCAGCCTGCCTGGAC
CGTGAACGTTGAGGATAGCGGCGAGATGTTCAGATGGAACGCCAGCGACGTGCGCGACCTGGACT
GTGACCTGAGAAACAGAAGCAGCGGCAGCCACAGAAGCACCTCTGGCTCTCAGCTGTACGTGTGG
GCCAAAGATCACCCCAAAGTGTGGGGCACCAAGCCTGTGTGTGCTCCTAGAGGCAGCAGCCTGAA
CCAGAGCCTGATCAACCAGGACCTGACAGTGGCTCCTGGCAGCACACTGTGGCTGTCTTGCGGAG
TTCCTCCAGTGCCTGTGGCCAAGGGCAGCATCTCTTGGACACACGTGCACCCTAGAAGGCCCAAC
GTGTCCCTGCTGTCTCTGTCTCTCGGCGGAGAACATCCCGTGCGCGAGATGTGGGTTTGGGGATC
TCTTCTGCTGCTGCCACAGGCCACAGCTCTGGATGAGGGCACCTACTACTGCCTGAGGGGCAACC
TGACCATCGAGAGACACGTGAAAGTGATCGCCAGATCCGCCGTGTGGCTCTGGCTTCTTAGAACA APPENDIX-continued

| AMINO ACID AND NUCLEIC ACID SEQUENCES |
|---|
| GGCGGATGGATCGTGCCCGTGGTCACCCTGGTGTACGTGATCTTCTGCATGGTGTCCCTGGTGGC<br>CTTCCTGTACTGCCAGAGAGCCTTCATCCTGAGAAGAAAGCGCAAGCGGATGACCTGATGA |

SEQUENCE LISTING (884 sequences)

SEQ ID NO: 1-100 - skipped (100 entries)

SEQ ID NO: 101 - protein, 1456 aa, Artificial Sequence [sequence omitted]

SEQ ID NO: 102 - protein, 1121 aa, Artificial Sequence
  Human CD163
MSKLRMVLLEDSGSADFRRHFVNLSPFTITVVLLLSACFVTSSLGGTDKELRLVDGENKCSGRVEVKVQEEWGTVCNNGWSMEAVSVICNQLGCPTAIKAPGWANSSAGSGRIWMDHVSCRGNESALWDCKHDGWGKHSNCTHQQDAGVTCSDGSNLEMRLTRGGNMCSGRIEIKFQGRWGTVCDDNFNIDHASVICRQLECGSAVSFSGSSNFGEGSGPIWFDDLICNGNESALWNCKHQGWGKHNCDHAEDAGVICSKGADLSLRLVDGVTECSGRLEVRFQGEWGTICDDGWDSYDAAVACKQLGCPTAVTAIGRVNASKGFGHIWLDSVSCQGHEPAVWQCKHHEWGKHYCNHNEDAGVTCSDGSDLELRLRGGGSRCAGTVEVEIQRLLGKVCDRGWGLKEADVVCRQLGCGSALKTSYQVYSKIQATNTWLFLSSCNGNETSLWDCKNWQWGGLTCDHYEEAKITCSAHREPRLVGGDIPCSGRVEVKHGDTWGSICDSDFSLEAASVLCRELQCGTVVSILGGAHFGEGNGQIWAEEFQCEGHESHLSLCPVAPRPEGTCSHSRDVGVVCSRYTEIRLVNGKTPCEGRVELKTLGAWGSLCNSHWDIEDAHVLCQQLKCGVALSTPGGARFGKGNGQIWRHMFHCTGTEQHMGDCPVTALGASLCPSEQVASVICSGNQSQTLSSCNSSSLGPTRPTIPEESAVACIESGQLRLVNGGGRCAGRVEIYHEGSWGTICDDSWDLSDAHVVCRQLGCGEAINATGSAHFGEGTGPIWLDEMKCNGKESRIWQCHSHGWGQQNCRHKEDAGVICSEFMSLRLTSEASREACAGRLEVFYNGAWGTVGKSSMSETTVGVVCRQLGCADKGKINPASLDKAMSIPMWVDNVQCPKGPDTLWQCPSSPWEKRLASPSEETWITCDNKIRLQEGPTSCSGRVEIWHGGSWGTVCDDSWDLDDAQVVCQQLGCGPALKAFKEAEFGQGTGPIWLNEVKCKGNESSLWDCPARRWGHSECGHKEDAAVNCTDISVQKTPQKATTGRSSRQSSFIAVGILGVVLLAIFVALFFLTKKRRQRQRLAVSSRGENLVHQIQYREMNSCLNADDLDLMNSSGGHSEPH

SEQ ID NO: 103 - protein, 129 aa, Artificial Sequence
  Human Fn14
MARGSLRRLLRLLVLGLWLALLRSVAGEQAPGTAPCSRGSSWSADLDKCMDCASCRARPHSDFCLGCAAAPPAPFRLLWPILGGALSLTFVLGLLSGFLVWRRCRRREKFTTPIEETGGEGCPAVALIQ

SEQ ID NO: 104 - skipped

SEQ ID NO: 105 - protein, 19 aa, Artificial Sequence
  Leader sequence
MEWTWVFLFLLSVTAGVHS

SEQ ID NO: 106-109 - skipped (4 entries)

SEQ ID NO: 110 - protein, 130 aa, Artificial Sequence
  Anti-CD206 nanobody NbMMRm22.84
QVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSS

SEQ ID NO: 111 - protein, 13 aa, Artificial Sequence
  Anti-CD206 nanobody NbMMRm22.84 CDR1
GRTFSNYVNYAMG

SEQ ID NO: 112 - protein, 9 aa, Artificial Sequence
  Anti-CD206 nanobody NbMMRm22.84 CDR2
SISWSSVTT

SEQ ID NO: 113 - protein, 18 aa, Artificial Sequence
  Anti-CD206 nanobody NbMMRm22.84 CDR3
HLAQYSDYAYRDPHQFGA

SEQ ID NO: 114 - protein, 131 aa, Artificial Sequence
  Anti-CD206 nanobody NbMMRm5.38
QVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSS

SEQ ID NO: 115 - protein, 10 aa, Artificial Sequence
  Anti-CD206 nanobody NbMMRm5.38 CDR1
GFTDDDYDIG

SEQ ID NO: 116 - protein, 9 aa, Artificial Sequence
  Anti-CD206 nanobody NbMMRm5.38 CDR2
CISSSDGST

SEQ ID NO: 117 - protein, 22 aa, Artificial Sequence
  Anti-CD206 nanobody NbMMRm5.38 CDR3
DFFRWDSGSYYVRGCRHATYDY

SEQ ID NO: 118 - protein, 121 aa, Artificial Sequence
  Anti-Fn14 antibody AbP4A8 heavy chain variable domain (P4A8VH)
QVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSS

SEQ ID NO: 119 - protein, 5 aa, Artificial Sequence
  Anti-Fn14 antibody AbP4A8 heavy chain variable domain CDR1
DYGMH

SEQ ID NO: 120 - protein, 17 aa, Artificial Sequence
  Anti-Fn14 antibody AbP4A8 heavy chain variable domain CDR2
VISTYNGYTNYNQKFKG

SEQ ID NO: 121 - protein, 12 aa, Artificial Sequence
  Anti-Fn14 antibody AbP4A8 heavy chain variable domain CDR3
AYYGNLYYAMDY

SEQ ID NO: 122 - protein, 111 aa, Artificial Sequence
  Anti-Fn14 antibody AbP4A8 light chain variable domain (P4A8VL)
DIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIK

SEQ ID NO: 123 - protein, 15 aa, Artificial Sequence
  Anti-Fn14 antibody AbP4A8 light chain variable domain CDR1
RASKSVSTSSYSYMH

SEQ ID NO: 124 - protein, 6 aa, Artificial Sequence
  Anti-Fn14 antibody AbP4A8 light chain variable domain CDR2
ASNLES

SEQ ID NO: 125 - protein, 9 aa, Artificial Sequence
  Anti-Fn14 antibody AbP4A8 light chain variable domain CDR3
QHSRELPFT

SEQ ID NO: 126 - protein, 121 aa, Artificial Sequence
  Anti-Fn14 antibody AbP3G5 heavy chain variable domain (P3G5VH)
QVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSS

SEQ ID NO: 127 - protein, 5 aa, Artificial Sequence
  Anti-Fn14 antibody AbP3G5 heavy chain variable domain CDR1
DYGIH

SEQ ID NO: 128 - protein, 17 aa, Artificial Sequence
  Anti-Fn14 antibody AbP3G5 heavy chain variable domain CDR2
VISTYNGYTNYNQKFKG

SEQ ID NO: 129 - protein, 12 aa, Artificial Sequence
  Anti-Fn14 antibody AbP3G5 heavy chain variable domain CDR3
AYYGNLYYAMDY

SEQ ID NO: 130 - protein, 111 aa, Artificial Sequence
  Anti-Fn14 antibody AbP3G5 light chain variable domain (P3G5VL)
DIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIK

SEQ ID NO: 131 - protein, 15 aa, Artificial Sequence
  Anti-Fn14 antibody AbP3G5 light chain variable domain CDR1
RANKSVSTSSYSYMH

SEQ ID NO: 132 - protein, 6 aa, Artificial Sequence
  Anti-Fn14 antibody AbP3G5 light chain variable domain CDR2
ASNLES

SEQ ID NO: 133 - protein, 9 aa, Artificial Sequence
  Anti-Fn14 antibody AbP3G5 light chain variable domain CDR3
QHSRELPFT

SEQ ID NO: 134 - protein, 248 aa, Artificial Sequence
  Human TWEAK (without Met/ATG)
AARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 135 - protein, 248 aa, Artificial Sequence
  Mouse TWEAK (without Met/ATG)
AARRSQRRRGRRGEPGTALLAPLVLSLGLALACLGLLLVVVSLGSWATLSAQEPSQEELTAEDRREPPELNPQTEESQDVVPFLEQLVRPRRSAPKGRKARPRRAIAAHYEVHPRPGQDGAQAGVDGTVSGWEETKINSSSPLRYDRQIGEFTVIRAGLYYLYCQVHFDEGKAVYLKLDLLVNGVLALRCLEEFSATAASSPGPQLRLCQVSGLLPLRPGSSLRIRTLPWAHLKAAPFLTYFGLFQVH

SEQ ID NO: 136 - protein, 402 aa, Artificial Sequence
  CD3zICS-CD28CS-TWEAK
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSKRSRLLHSDYMNMTPRRPGPTRKHYQPYAPPRDFAAYRSAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 137 - protein, 404 aa, Artificial Sequence
  CD3zICS-41BBCS-TWEAK
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRKRGRKKLLYIFKQPFMRPVQTTQEEDGCSCRFPEEEEGGCELAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 138 - protein, 386 aa, Artificial Sequence
  CD3zICS-DAP10CS-TWEAK
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRLCARPRRSPAQEDGKVYINMPGRGAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVH

SEQ ID NO: 139 - protein, 5 aa, Artificial Sequence
  Linker subunit (G4S)
GGGGS

SEQ ID NO: 140 - protein, 15 aa, Artificial Sequence
  Linker (G4S X3)
GGGGSGGGGSGGGGS

SEQ ID NO: 141 - protein, 247 aa, Artificial Sequence
  Anti-Fn14 scFvP4A8VHVL
QVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIK

SEQ ID NO: 142 - protein, 247 aa, Artificial Sequence
  Anti-Fn14 scFvP4A8VLVH
DIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSS

SEQ ID NO: 143 - protein, 247 aa, Artificial Sequence
  Anti-Fn14 scFvP3G5VHVL
QVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIK

SEQ ID NO: 144 - protein, 247 aa, Artificial Sequence
  Anti-Fn14 scFvP3G5VLVH
DIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSS

SEQ ID NO: 145 - protein, 18 aa, Artificial Sequence
  Human CD28 hinge (CD28H)
VKGKHLCPSPLFPGPSKP

SEQ ID NO: 146 - protein, 27 aa, Artificial Sequence
  Human CD28 transmembrane domain (CD28TM)
FWVLVVVGGVLACYSLLVTVAFIIFWV

SEQ ID NO: 147 - protein, 114 aa, Artificial Sequence
  Human CD3 zeta intracellular signaling domain (CD3zICS)
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 148-149 - skipped (2 entries)

SEQ ID NO: 150 - protein, 27 aa, Artificial Sequence
  T2A ribosomal skip sequence (T2A)
ARAKRSGSGEGRGSLLTCGDVEENPGP

SEQ ID NO: 151 - protein, 327 aa, Artificial Sequence
  Human truncated CD19 (trCD19)
MPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 152-154 - skipped (3 entries)

SEQ ID NO: 155 - protein, 48 aa, Artificial Sequence
  Human CD27 costimulatory domain (CD27CS)
QRRKYRSNKGESPVEPAEPCRYSCPREEEGSTIPIQEDYRKPEPACSP

SEQ ID NO: 156 - protein, 40 aa, Artificial Sequence
  Human CD28 costimulatory domain (CD28CS)
SKRSRLLHSDYMNMTPRRPGPTRKHYQPYAPPRDFAAYRS

SEQ ID NO: 157 - protein, 42 aa, Artificial Sequence
  4-1BB costimulatory domain (41BBCS)
KRGRKKLLYIFKQPFMRPVQTTQEEDGCSCRFPEEEEGGCEL

SEQ ID NO: 158 - protein, 24 aa, Artificial Sequence
  DAP10 costimulatory domain (DAP10CS)
LCARPRRSPAQEDGKVYINMPGRG

SEQ ID NO: 159 - skipped

SEQ ID NO: 160 - protein, 329 aa, Artificial Sequence
  NbMMRm22.84-CD28H-CD28TM-CD28CS-CD3zICS
QVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 161 - protein, 330 aa, Artificial Sequence
  NbMMRm5.38-CD28H-CD28TM-CD28CS-CD3zICS
QVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 162 - protein, 446 aa, Artificial Sequence
  scFvP4A8VHVL-CD28H-CD28TM-CD28CS-CD3zICS
QVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 163 - protein, 446 aa, Artificial Sequence
  scFvP4A8VLVH-CD28H-CD28TM-CD28CS-CD3zICS
DIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 164 - protein, 446 aa, Artificial Sequence
  scFvP3G5VHVL-CD28H-CD28TM-CD28CS-CD3zICS
QVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 165 - protein, 446 aa, Artificial Sequence
  scFvP3G5VLVH-CD28H-CD28TM-CD28CS-CD3zICS
DIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 166 - protein, 331 aa, Artificial Sequence
  NbMMRm22.84-CD28H-CD28TM-41BBCS-CD3zICS
QVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 167 - protein, 332 aa, Artificial Sequence
  NbMMRm5.38-CD28H-CD28TM-41BBCS-CD3zICS
QVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 168 - protein, 448 aa, Artificial Sequence
  scFvP4A8VHVL-CD28H-CD28TM-41BBCS-CD3zICS
QVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 169 - protein, 448 aa, Artificial Sequence
  scFvP4A8VLVH-CD28H-CD28TM-41BBCS-CD3zICS
DIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 170 - protein, 448 aa, Artificial Sequence
  scFvP3G5VHVL-CD28H-CD28TM-41BBCS-CD3zICS
QVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 171 - protein, 448 aa, Artificial Sequence
  scFvP3G5VLVH-CD28H-CD28TM-41BBCS-CD3zICS
DIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 172 - protein, 313 aa, Artificial Sequence
  NbMMRm22.84-CD28H-CD28TM-DAP10CS-CD3zICS
QVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 173 - protein, 314 aa, Artificial Sequence
  NbMMRm5.38-CD28H-CD28TM-DAP10CS-CD3zICS
QVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 174 - protein, 430 aa, Artificial Sequence
  scFvP4A8VHVL-CD28H-CD28TM-DAP10CS-CD3zICS
QVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 175 - protein, 430 aa, Artificial Sequence
  scFvP4A8VLVH-CD28H-CD28TM-DAP10CS-CD3zICS
DIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 176 - protein, 430 aa, Artificial Sequence
  scFvP3G5VHVL-CD28H-CD28TM-DAP10CS-CD3zICS
QVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 177 - protein, 430 aa, Artificial Sequence
  scFvP3G5VLVH-CD28H-CD28TM-DAP10CS-CD3zICS
DIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 178 - protein, 702 aa, Artificial Sequence
  LS-NbMMRm22.84-CD28H-CD28TM-CD28CS-CD3zICS-T2A-trCD19
MEWTWVFLFLLSVTAGVHSQVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 179 - protein, 703 aa, Artificial Sequence
  LS-NbMMRm5.38-CD28H-CD28TM-CD28CS-CD3zICS-T2A-trCD19
MEWTWVFLFLLSVTAGVHSQVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 180 - protein, 819 aa, Artificial Sequence
  LS-scFvP4A8VHVL-CD28H-CD28TM-CD28CS-CD3zICS-T2A-trCD19
MEWTWVFLFLLSVTAGVHSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 181 - protein, 819 aa, Artificial Sequence
  LS-scFvP4A8VLVH-CD28H-CD28TM-CD28CS-CD3zICS-T2A-trCD19
MEWTWVFLFLLSVTAGVHSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 182 - protein, 819 aa, Artificial Sequence
  LS-scFvP3G5VHVL-CD28H-CD28TM-CD28CS-CD3zICS-T2A-trCD19
MEWTWVFLFLLSVTAGVHSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 183 - protein, 819 aa, Artificial Sequence
  LS-scFvP3G5VLVH-CD28H-CD28TM-CD28CS-CD3zICS-T2A-trCD19
MEWTWVFLFLLSVTAGVHSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 184 - protein, 704 aa, Artificial Sequence
  LS-NbMMRm22.84-CD28H-CD28TM-41BBCS-CD3zICS-T2A-trCD19
MEWTWVFLFLLSVTAGVHSQVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 185 - protein, 705 aa, Artificial Sequence
  LS-NbMMRm5.38-CD28H-CD28TM-41BBCS-CD3zICS-T2A-trCD19
MEWTWVFLFLLSVTAGVHSQVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 186 - protein, 821 aa, Artificial Sequence
  LS-scFvP4A8VHVL-CD28H-CD28TM-41BBCS-CD3zICS-T2A-trCD19
MEWTWVFLFLLSVTAGVHSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 187 - protein, 821 aa, Artificial Sequence
  LS-scFvP4A8VLVH-CD28H-CD28TM-41BBCS-CD3zICS-T2A-trCD19
MEWTWVFLFLLSVTAGVHSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 188 - protein, 821 aa, Artificial Sequence
  LS-scFvP3G5VHVL-CD28H-CD28TM-41BBCS-CD3zICS-T2A-trCD19
MEWTWVFLFLLSVTAGVHSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 189 - protein, 821 aa, Artificial Sequence
  LS-scFvP3G5VLVH-CD28H-CD28TM-41BBCS-CD3zICS-T2A-trCD19
MEWTWVFLFLLSVTAGVHSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 190 - protein, 686 aa, Artificial Sequence
  LS-NbMMRm22.84-CD28H-CD28TM-DAP10CS-CD3zICS-T2A-trCD19
MEWTWVFLFLLSVTAGVHSQVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 191 - protein, 687 aa, Artificial Sequence
  LS-NbMMRm5.38-CD28H-CD28TM-DAP10CS-CD3zICS-T2A-trCD19
MEWTWVFLFLLSVTAGVHSQVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 192 - protein, 803 aa, Artificial Sequence
  LS-scFvP4A8VHVL-CD28H-CD28TM-DAP10CS-CD3zICS-T2A-trCD19
MEWTWVFLFLLSVTAGVHSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 193 - protein, 803 aa, Artificial Sequence
  LS-scFvP4A8VLVH-CD28H-CD28TM-DAP10CS-CD3zICS-T2A-trCD19
MEWTWVFLFLLSVTAGVHSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 194 - protein, 803 aa, Artificial Sequence
  LS-scFvP3G5VHVL-CD28H-CD28TM-DAP10CS-CD3zICS-T2A-trCD19
MEWTWVFLFLLSVTAGVHSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 195 - protein, 803 aa, Artificial Sequence
  LS-scFvP3G5VLVH-CD28H-CD28TM-DAP10CS-CD3zICS-T2A-trCD19
MEWTWVFLFLLSVTAGVHSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 196 - protein, 756 aa, Artificial Sequence
  CD3zICS-CD28CS-TWEAK-T2A-trCD19
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRSKRSRLLHSDYMNMTPRRPGPTRKHYQPYAPPRDFAAYRSAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVHARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 197 - protein, 758 aa, Artificial Sequence
  CD3zICS-41BBCS -TWEAK-T2A-trCD19
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRKRGRKKLLYIFKQPFMRPVQTTQEEDGCSCRFPEEEEGGCELAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVHARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 198 - protein, 740 aa, Artificial Sequence
  CD3zICS-DAP10CS-TWEAK-T2A-trCD19
LRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPRLCARPRRSPAQEDGKVYINMPGRGAARRSQRRRGRRGEPGTALLVPLALGLGLALACLGLLLAVVSLGSRASLSAQEPAQEELVAEEDQDPSELNPQTEESQDPAPFLNRLVRPRRSAPKGRKTRARRAIAAHYEVHPRPGQDGAQAGVDGTVSGWEEARINSSSPLRYNRQIGEFIVTRAGLYYLYCQVHFDEGKAVYLKLDLLVDGVLALRCLEEFSATAASSLGPQLRLCQVSGLLALRPGSSLRIRTLPWAHLKAAPFLTYFGLFQVHARAKRSGSGEGRGSLLTCGDVEENPGPMPPPRLLFFLLFLTPMEVRPEEPLVVKVEEGDNAVLQCLKGTSDGPTQQLTWSRESPLKPFLKLSLGLPGLGIHMRPLAIWLFIFNVSQQMGGFYLCQPGPPSEKAWQPGWTVNVEGSGELFRWNVSDLGGLGCGLKNRSSEGPSSPSGKLMSPKLYVWAKDRPEIWEGEPPCLPPRDSLNQSLSQDLTMAPGSTLWLSCGVPPDSVSRGPLSWTHVHPKGPKSLLSLELKDDRPARDMWVMETGLLLPRATAQDAGKYYCHRGNLTMSFHLEITARPVLWHWLLRTGGWKVSAVTLAYLIFCLCSLVGILHLQRALVLRRKRKRMT

SEQ ID NO: 199-204 - skipped (6 entries)

SEQ ID NO: 205 - DNA, 57 bp, Artificial Sequence
  Leader sequence
atggagtggacctgggtgttcctgttcctgctgagcgtgaccgccggcgtgcacagc

SEQ ID NO: 206-209 - skipped (4 entries)

SEQ ID NO: 210 - DNA, 390 bp, Artificial Sequence
  Anti-CD206 nanobody NbMMRm22.84
caggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctct

SEQ ID NO: 211-213 - skipped (3 entries)

SEQ ID NO: 214 - DNA, 393 bp, Artificial Sequence
  Anti-CD206 nanobody NbMMRm5.38
caggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatct

SEQ ID NO: 215-217 - skipped (3 entries)

SEQ ID NO: 218 - DNA, 363 bp, Artificial Sequence
  Anti-Fn14 antibody AbP4A8 heavy chain variable domain (P4A8VH)
caggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctca

SEQ ID NO: 219-221 - skipped (3 entries)

SEQ ID NO: 222 - DNA, 333 bp, Artificial Sequence
  Anti-Fn14 antibody AbP4A8 light chain variable domain (P4A8VL)
gacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaa

SEQ ID NO: 223-225 - skipped (3 entries)

SEQ ID NO: 226 - DNA, 363 bp, Artificial Sequence
  Anti-Fn14 antibody AbP3G5 heavy chain variable domain (P3G5VH)
caggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctca

SEQ ID NO: 227-229 - skipped (3 entries)

SEQ ID NO: 230 - DNA, 333 bp, Artificial Sequence
  Anti-Fn14 antibody AbP3G5 light chain variable domain (P3G5VL)
gacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaa

SEQ ID NO: 231-233 - skipped (3 entries)

SEQ ID NO: 234 - DNA, 747 bp, Artificial Sequence
  Human TWEAK (without Met/ATG)
gccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactga

SEQ ID NO: 235 - DNA, 747 bp, Artificial Sequence
  Mouse TWEAK (without Met/ATG)
gccgcccgtcggagccagaggcggagggggcgccggggggagccgggcaccgccctgctggccccgctggtgctgagcctgggcctggcgctggcctgccttggcctcctgctggtcgtggtcagcctggggagctgggcaacgctgtctgcccaggagccttctcaggaggagctgacagcagaggaccgccgggagccccctgaactgaatccccagacagaggaaagccaggatgtggtacctttcttggaacaactagtccggcctcgaagaagtgctcctaaaggccggaaggcgcggcctcgccgagctattgcagcccattatgaggttcatcctcggccaggacaggatggagcacaagcaggtgtggatgggacagtgagtggctgggaagagaccaaaatcaacagctccagccctctgcgctacgaccgccagattggggaatttacagtcatcagggctgggctctactacctgtactgtcaggtgcactttgatgagggaaaggctgtctacctgaagctggacttgctggtgaacggtgtgctggccctgcgctgcctggaagaattctcagccacagcagcaagctctcctgggccccagctccgtttgtgccaggtgtctgggctgttgccgctgcggccagggtcttcccttcggatccgcaccctcccctgggctcatcttaaggctgcccccttcctaacctactttggactctttcaagttcactga

SEQ ID NO: 236 - DNA, 1212 bp, Artificial Sequence
  CD3zICS-CD28CS-TWEAK
cttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcaggagtaagaggagcaggctcctgcacagtgactacatgaacatgactccccgccgccccgggcccacccgcaagcattaccagccctatgccccaccacgcgacttcgcagcctatcgctccgccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactga

SEQ ID NO: 237 - DNA, 1215 bp, Artificial Sequence
  CD3zICS-41BBCS-TWEAK
cttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcaaacggggcagaaagaaactcctgtatatattcaaacaaccatttatgagaccagtacaaactactcaagaggaagatggctgtagctgccgatttccagaagaagaagaaggaggatgtgaactggccggaggggcaaggggcacgatggcctttaccagggtctcagtacagccaccaaggacacctacgacgcccttcacatgcaggccctgccccctcgcgccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactga

SEQ ID NO: 238 - DNA, 1161 bp, Artificial Sequence
  CD3zICS-DAP10CS-TWEAK
cttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcctgtgcgcacgcccacgccgcagccccgcccaagaagatggcaaagtctacatcaacatgccaggcaggggcgccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactga

SEQ ID NO: 239 - skipped

SEQ ID NO: 240 - DNA, 45 bp, Artificial Sequence
  Linker (G4S X3)
ggtggtggtggttctggcggcggcggctccggtggtggtggttcc

SEQ ID NO: 241 - DNA, 741 bp, Artificial Sequence
  Anti-Fn14 scFvP4A8VHVL
caggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaa

SEQ ID NO: 242 - DNA, 741 bp, Artificial Sequence
  Anti-Fn14 scFvP4A8VLVH
gacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctca

SEQ ID NO: 243 - DNA, 741 bp, Artificial Sequence
  Anti-Fn14 scFvP3G5VHVL
caggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaa

SEQ ID NO: 244 - DNA, 741 bp, Artificial Sequence
  Anti-Fn14 scFvP3G5VLVH
gacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctca

SEQ ID NO: 245 - DNA, 54 bp, Artificial Sequence
  Human CD28 hinge (CD28H)
gtgaaagggaaacacctttgtccaagtcccctatttcccggaccttctaagccc

SEQ ID NO: 246 - DNA, 81 bp, Artificial Sequence
  Human CD28 transmembrane domain (CD28TM)
ttttgggtgctggtggtggttggtggagtcctggcttgctatagcttgctagtaacagtggcctttattattttctgggtg

SEQ ID NO: 247 - DNA, 342 bp, Artificial Sequence
  Human CD3 zeta intracellular signaling domain (CD3zICS)
cttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 248-249 - skipped (2 entries)

SEQ ID NO: 250 - DNA, 81 bp, Artificial Sequence
  T2A ribosomal skip sequence (T2A)
gccagggccaaaaggtctggctccggtgagggcagaggaagtcttctaacatgcggtgacgtggaggagaatcccggccct

SEQ ID NO: 251 - DNA, 984 bp, Artificial Sequence
  Human truncated CD19 (trCD19)
atgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 252-254 - skipped (3 entries)

SEQ ID NO: 255 - DNA, 168 bp, Artificial Sequence
  Human CD27 costimulatory domain (CD27CS)
aggagtaagaggagcctcgagcaacgaaggaaatatagatcaaacaaaggagaaagtcctgtggagcctgcagagccttgtcgttacagctgccccagggaggaggagggcagcaccatccccatccaggaggattaccgaaaaccggagcctgcctgctcccccaag

SEQ ID NO: 256 - DNA, 123 bp, Artificial Sequence
  Human CD28 costimulatory domain (CD28CS)
aggagtaagaggagcaggctcctgcacagtgactacatgaacatgactccccgccgccccgggcccacccgcaagcattaccagccctatgccccaccacgcgacttcgcagcctatcgctcc

SEQ ID NO: 257 - DNA, 126 bp, Artificial Sequence
  4-1BB costimulatory domain (41BBCS)
aaacggggcagaaagaaactcctgtatatattcaaacaaccatttatgagaccagtacaaactactcaagaggaagatggctgtagctgccgatttccagaagaagaagaaggaggatgtgaactg

SEQ ID NO: 258 - DNA, 72 bp, Artificial Sequence
  DAP10 costimulatory domain (DAP10CS)
ctgtgcgcacgcccacgccgcagccccgcccaagaagatggcaaagtctacatcaacatgccaggcaggggc

SEQ ID NO: 259 - skipped

SEQ ID NO: 260 - DNA, 990 bp, Artificial Sequence
  NbMMRm22.84-CD28H-CD28TM-CD28CS-CD3zICS
caggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 261 - DNA, 993 bp, Artificial Sequence
  NbMMRm5.38-CD28H-CD28TM-CD28CS-CD3zICS
caggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 262 - DNA, 1341 bp, Artificial Sequence
  scFvP4A8VHVL-CD28H-CD28TM-CD28CS-CD3zICS
caggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 263 - DNA, 1341 bp, Artificial Sequence
  scFvP4A8VLVH-CD28H-CD28TM-CD28CS-CD3zICS
gacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 264 - DNA, 1341 bp, Artificial Sequence
  scFvP3G5VHVL-CD28H-CD28TM-CD28CS-CD3zICS
caggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 265 - DNA, 1341 bp, Artificial Sequence
  scFvP3G5VLVH-CD28H-CD28TM-CD28CS-CD3zICS
gacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 266 - DNA, 993 bp, Artificial Sequence
  NbMMRm22.84-CD28H-CD28TM-41BBCS-CD3zICS
caggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 267 - DNA, 996 bp, Artificial Sequence
  NbMMRm5.38-CD28H-CD28TM-41BBCS-CD3zICS
caggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 268 - DNA, 1344 bp, Artificial Sequence
  scFvP4A8VHVL-CD28H-CD28TM-41BBCS-CD3zICS
caggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 269 - DNA, 1344 bp, Artificial Sequence
  scFvP4A8VLVH-CD28H-CD28TM-41BBCS-CD3zICS
gacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 270 - DNA, 1344 bp, Artificial Sequence
  scFvP3G5VHVL-CD28H-CD28TM-41BBCS-CD3zICS
caggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 271 - DNA, 1344 bp, Artificial Sequence
  scFvP3G5VLVH-CD28H-CD28TM-41BBCS-CD3zICS
gacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 272 - DNA, 939 bp, Artificial Sequence
  NbMMRm22.84-CD28H-CD28TM-DAP10CS-CD3zICS
caggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 273 - DNA, 942 bp, Artificial Sequence
  NbMMRm5.38-CD28H-CD28TM-DAP10CS-CD3zICS
caggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 274 - DNA, 1290 bp, Artificial Sequence
  scFvP4A8VHVL-CD28H-CD28TM-DAP10CS-CD3zICS
caggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 275 - DNA, 1290 bp, Artificial Sequence
  scFvP4A8VLVH-CD28H-CD28TM-DAP10CS-CD3zICS
gacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 276 - DNA, 1290 bp, Artificial Sequence
  scFvP3G5VHVL-CD28H-CD28TM-DAP10CS-CD3zICS
caggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 277 - DNA, 1290 bp, Artificial Sequence
  scFvP3G5VLVH-CD28H-CD28TM-DAP10CS-CD3zICS
gacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 278 - DNA, 2112 bp, Artificial Sequence
  LS-NbMMRm22.84-CD28H-CD28TM-CD28CS-CD3zICS-T2A-trCD19
atggagtggacctgggtgttcctgttcctgctgagcgtgaccgccggcgtgcacagccaggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 279 - DNA, 2115 bp, Artificial Sequence
  LS-NbMMRm5.38-CD28H-CD28TM-CD28CS-CD3zICS-T2A-trCD19
atggagtggacctgggtgttcctgttcctgctgagcgtgaccgccggcgtgcacagccaggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 280 - DNA, 2463 bp, Artificial Sequence
  LS-scFvP4A8VHVL-CD28H-CD28TM-CD28CS-CD3zICS-T2A-trCD19
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 281 - DNA, 2463 bp, Artificial Sequence
  LS-scFvP4A8VLVH-CD28H-CD28TM-CD28CS-CD3zICS-T2A-trCD19
atggagtggacctgggtgttcctgttcctgctgagcgtgaccgccggcgtgcacagcgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 282 - DNA, 2463 bp, Artificial Sequence
  LS-scFvP3G5VHVL-CD28H-CD28TM-CD28CS-CD3zICS-T2A-trCD19
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 283 - DNA, 2463 bp, Artificial Sequence
  LS-scFvP3G5VLVH-CD28H-CD28TM-CD28CS-CD3zICS-T2A-trCD19
atggagtggacctgggtgttcctgttcctgctgagcgtgaccgccggcgtgcacagcgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 284 - DNA, 2115 bp, Artificial Sequence
  LS-NbMMRm22.84-CD28H-CD28TM-41BBCS-CD3zICS-T2A-trCD19
atggagtggacctgggtgttcctgttcctgctgagcgtgaccgccggcgtgcacagccaggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 285 - DNA, 2118 bp, Artificial Sequence
  LS-NbMMRm5.38-CD28H-CD28TM-41BBCS-CD3zICS-T2A-trCD19
atggagtggacctgggtgttcctgttcctgctgagcgtgaccgccggcgtgcacagccaggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 286 - DNA, 2466 bp, Artificial Sequence
  LS-scFvP4A8VHVL-CD28H-CD28TM-41BBCS-CD3zICS-T2A-trCD19
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 287 - DNA, 2466 bp, Artificial Sequence
  LS-scFvP4A8VLVH-CD28H-CD28TM-41BBCS-CD3zICS-T2A-trCD19
atggagtggacctgggtgttcctgttcctgctgagcgtgaccgccggcgtgcacagcgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 288 - DNA, 2466 bp, Artificial Sequence
  LS-scFvP3G5VHVL-CD28H-CD28TM-41BBCS-CD3zICS-T2A-trCD19
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 289 - DNA, 2466 bp, Artificial Sequence
  LS-scFvP3G5VLVH-CD28H-CD28TM-41BBCS-CD3zICS-T2A-trCD19
atggagtggacctgggtgttcctgttcctgctgagcgtgaccgccggcgtgcacagcgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 290 - DNA, 2061 bp, Artificial Sequence
  LS-NbMMRm22.84-CD28H-CD28TM-DAP10CS-CD3zICS-T2A-trCD19
atggagtggacctgggtgttcctgttcctgctgagcgtgaccgccggcgtgcacagccaggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 291 - DNA, 2064 bp, Artificial Sequence
  LS-NbMMRm5.38-CD28H-CD28TM-DAP10CS-CD3zICS-T2A-trCD19
atggagtggacctgggtgttcctgttcctgctgagcgtgaccgccggcgtgcacagccaggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 292 - DNA, 2412 bp, Artificial Sequence
  LS-scFvP4A8VHVL-CD28H-CD28TM-DAP10CS-CD3zICS-T2A-trCD19
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 293 - DNA, 2412 bp, Artificial Sequence
  LS-scFvP4A8VLVH-CD28H-CD28TM-DAP10CS-CD3zICS-T2A-trCD19
atggagtggacctgggtgttcctgttcctgctgagcgtgaccgccggcgtgcacagcgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 294 - DNA, 2412 bp, Artificial Sequence
  LS-scFvP3G5VHVL-CD28H-CD28TM-DAP10CS-CD3zICS-T2A-trCD19
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 295 - DNA, 2412 bp, Artificial Sequence
  LS-scFvP3G5VLVH-CD28H-CD28TM-DAP10CS-CD3zICS-T2A-trCD19
atggagtggacctgggtgttcctgttcctgctgagcgtgaccgccggcgtgcacagcgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcgccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 296 - DNA, 2277 bp, Artificial Sequence
  CD3zICS-CD28CS-TWEAK-T2A-trCD19
cttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcaggagtaagaggagcaggctcctgcacagtgactacatgaacatgactccccgccgccccgggcccacccgcaagcattaccagccctatgccccaccacgcgacttcgcagcctatcgctccgccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgagccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 297 - DNA, 2280 bp, Artificial Sequence
  CD3zICS-41BBCS -TWEAK-T2A-trCD19
cttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcaaacggggcagaaagaaactcctgtatatattcaaacaaccatttatgagaccagtacaaactactcaagaggaagatggctgtagctgccgatttccagaagaagaagaaggaggatgtgaactggccggaggggcaaggggcacgatggcctttaccagggtctcagtacagccaccaaggacacctacgacgcccttcacatgcaggccctgccccctcgcgccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgagccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 298 - DNA, 2226 bp, Artificial Sequence
  CD3zICS-DAP10CS-TWEAK-T2A-trCD19
cttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgcctgtgcgcacgcccacgccgcagccccgcccaagaagatggcaaagtctacatcaacatgccaggcaggggcgccgcccgtcggagccagaggcggagggggcgccggggggagccgggcaccgccctgctggtcccgctcgcgctgggcctgggcctggcgctggcctgcctcggcctcctgctggccgtggtcagtttggggagccgggcatcgctgtccgcccaggagcctgcccaggaggagctggtggcagaggaggaccaggacccgtcggaactgaatccccagacagaagaaagccaggatcctgcgcctttcctgaaccgactagttcggcctcgcagaagtgcacctaaaggccggaaaacacgggctcgaagagcgatcgcagcccattatgaagttcatccacgacctggacaggacggagcgcaggcaggtgtggacgggacagtgagtggctgggaggaagccagaatcaacagctccagccctctgcgctacaaccgccagatcggggagtttatagtcacccgggctgggctctactacctgtactgtcaggtgcactttgatgaggggaaggctgtctacctgaagctggacttgctggtggatggtgtgctggccctgcgctgcctggaggaattctcagccactgcggccagttccctcgggccccagctccgcctctgccaggtgtctgggctgttggccctgcggccagggtcctccctgcggatccgcaccctcccctgggcccatctcaaggctgcccccttcctcacctacttcggactcttccaggttcactgagccagggccaaaaggtctggctccggtgagggcagaggaagtcttctaacatgcggtgacgtggaggagaatcccggccctatgccacctcctcgcctcctcttcttcctcctcttcctcacccccatggaagtcaggcccgaggaacctctagtggtgaaggtggaagagggagataacgctgtgctgcagtgcctcaaggggacctcagatggccccactcagcagctgacctggtctcgggagtccccgcttaaacccttcttaaaactcagcctggggctgccaggcctgggaatccacatgaggcccctggccatctggcttttcatcttcaacgtctctcaacagatggggggcttctacctgtgccagccggggcccccctctgagaaggcctggcagcctggctggacagtcaatgtggagggcagcggggagctgttccggtggaatgtttcggacctaggtggcctgggctgtggcctgaagaacaggtcctcagagggccccagctccccttccgggaagctcatgagccccaagctgtatgtgtgggccaaagaccgccctgagatctgggagggagagcctccgtgtctcccaccgagggacagcctgaaccagagcctcagccaggacctcaccatggcccctggctccacactctggctgtcctgtggggtaccccctgactctgtgtccaggggccccctctcctggacccatgtgcaccccaaggggcctaagtcattgctgagcctagagctgaaggacgatcgcccggccagagatatgtgggtaatggagacgggtctgttgttgccccgggccacagctcaagacgctggaaagtattattgtcaccgtggcaacctgaccatgtcattccacctggagatcactgctcggccagtactatggcactggctgctgaggactggtggctggaaggtctcagctgtgactttggcttatctgatcttctgcctgtgttcccttgtgggcattcttcatcttcaaagagccctggtcctgaggaggaaaagaaagcgaatgacttaa

SEQ ID NO: 299-300 - skipped (2 entries)

SEQ ID NO: 301 - protein, 106 aa, Artificial Sequence
  Human glutaredoxin 1 (hGRX1)
MAQEFVNCKIQPGKVVVFIKPTCPYCRRAQEILSQLPIKQGLLEFVDITATNHTNEIQDYLQQLTGARTVPRVFIGKDCIGGCSDLVSLQQSGELLTRLKQIGALQ

SEQ ID NO: 302 - protein, 124 aa, Artificial Sequence
  Human glutaredoxin 2 (hGRX2)
MESNTSSSLENLATAPVNQIQETISDNCVVIFSKTSCSYCTMAKKLFHDMNVNYKVVELDLLEYGNQFQDALYKMTGERTVPRIFVNGTFIGGATDTHRLHKEGKLLPLVHQCYLKKSKRKEFQ

SEQ ID NO: 303 - protein, 335 aa, Artificial Sequence
  Human glutaredoxin 3 (hGRX3)
MAAGAAEAAVAAVEEVGSAGQFEELLRLKAKSLLVVHFWAPWAPQCAQMNEVMAELAKELPQVSFVKLEAEGVPEVSEKYEISSVPTFLFFKNSQKIDRLDGAHAPELTKKVQRHASSGSFLPSANEHLKEDLNLRLKKLTHAAPCMLFMKGTPQEPRCGFSKQMVEILHKHNIQFSSFDIFSDEEVRQGLKAYSSWPTYPQLYVSGELIGGLDIIKELEASEELDTICPKAPKLEERLKVLTNKASVMLFMKGNKQEAKCGFSKQILEILNSTGVEYETFDILEDEEVRQGLKAYSNWPTYPQLYVKGELVGGLDIVKELKENGELLPILRGEN

SEQ ID NO: 304 - skipped

SEQ ID NO: 305 - protein, 157 aa, Artificial Sequence [sequence omitted]

SEQ ID NO: 306-310 - skipped (5 entries)

SEQ ID NO: 311 - protein, 107 aa, Artificial Sequence
  Mouse glutaredoxin 1 (mGRX1)
MAQEFVNCKIQSGKVVVFIKPTCPYCRKTQEILSQLPFKQGLLEFVDITATNNTSAIQDYLQQLTGARTVPRVFIGKDCIGGCSDLISMQQTGELMTRLKQIGALQL

SEQ ID NO: 312-321 - skipped (10 entries)

SEQ ID NO: 322 - protein, 106 aa, Artificial Sequence
  Functional human GRX1 variant 2 (hGRX1v2) -EFVA- mutant
MAQEFVNCKIQPGKVVVFIKPTCPYCRRAQEILSQLPIKQGLLEFVAITATNHTNEIQDYLQQLTGARTVPRVFIGKDCIGGCSDLVSLQQSGELLTRLKQIGALQ

SEQ ID NO: 323-331 - skipped (9 entries)

SEQ ID NO: 332 - protein, 106 aa, Artificial Sequence
  Functional human GRX1 variant 12 (hGRX1v2) -C7S C79S C83S- mutant
MAQEFVNSKIQPGKVVVFIKPTCPYCRRAQEILSQLPIKQGLLEFVDITATNHTNEIQDYLQQLTGARTVPRVFIGKDSIGGSSDLVSLQQSGELLTRLKQIGALQ

SEQ ID NO: 333-340 - skipped (8 entries)

SEQ ID NO: 341 - protein, 210 aa, Artificial Sequence
  Human glutathione S-transferase P(hGSTP)
MPPYTVVYFPVRGRCAALRMLLADQGQSWKEEVVTVETWQEGSLKASCLYGQLPKFQDGDLTLYQSNTILRHLGRTLGLYGKDQQEAALVDMVNDGVEDLRCKYISLIYTNYEAGKDDYVKALPGQLKPFETLLSQNQGGKTFIVGDQISFADYNLLDLLLIHEVLAPGCLDAFPLLSAYVGRLSARPKLKAFLASPEYVNLPINGNGKQ

SEQ ID NO: 342-350 - skipped (9 entries)

SEQ ID NO: 351 - protein, 210 aa, Artificial Sequence
  Mouse glutathione S-transferase P (mGSTP)
MPPYTIVYFPVRGRCEAMRMLLADQGQSWKEEVVTIDTWMQGLLKPTCLYGQLPKFEDGDLTLYQSNAILRHLGRSLGLYGKNQREAAQMDMVNDGVEDLRGKYVTLIYTNYENGKNDYVKALPGHLKPFETLLSQNQGGKAFIVGDQISFADYNLLDLLLIHQVLAPGCLDNFPLLSAYVARLSARPKIKAFLSSPEHVNRPINGNGKQ

SEQ ID NO: 352-400 - skipped (49 entries)

SEQ ID NO: 401 - DNA, 321 bp, Artificial Sequence
  Human glutaredoxin 1 (hGRX1)
atggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtag

SEQ ID NO: 402 - DNA, 375 bp, Artificial Sequence
  Human glutaredoxin 2 (hGRX2)
atggagagcaatacatcatcatctttggagaatttagcgacggcgcctgtgaaccagatccaagaaacaatttctgataattgtgtggtgattttctcaaaaacatcctgttcttactgtacaatggcaaaaaagcttttccatgacatgaatgttaactataaagtggtggaactggacctgcttgaatatggaaaccagttccaagatgctctttacaaaatgactggtgaaagaactgttccaagaatatttgtcaatggtacttttattggaggtgcaactgacactcataggcttcacaaagaaggaaaattgctcccactagttcatcagtgttatttaaaaaaaagtaagaggaaagaatttcagtga

SEQ ID NO: 403 - DNA, 960 bp, Artificial Sequence
  Human glutaredoxin 3 (hGRX3)
ggctcagccgggcagtttgaggagctgctgcgcctcaaagccaagtccctccttgtggtccatttctgggcaccatgggctccacagtgtgcacagatgaacgaagttatggcagagttagctaaagaactccctcaagtttcatttgtgaagttggaagctgaaggtgttcctgaagtatctgaaaaatatgaaattagctctgttcccacttttctgtttttcaagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtttcagcaagcagatggtggaaattcttcacaaacataatattcagtttagcagttttgatatcttctcagatgaagaggttcgacagggactcaaagcctattccagttggcctacctatcctcagctctatgtttctggagagctcataggaggacttgatataattaaggagctagaagcatctgaagaactagatacaatttgtcccaaagctcccaaattagaggaaaggctcaaagtgctgacaaataaagcttctgtgatgctctttatgaaaggaaacaaacaggaagcaaaatgtggattcagcaaacaaattctggaaatactaaatagtactggtgttgaatatgaaacattcgatatattggaggatgaagaagttcggcaaggattaaaagcttactcaaattggccaacataccctcagctgtatgtgaaaggggagctggtgggaggattggatattgtgaaggaactgaaagaaaatggtgaattgctgcctatactgagaggagaaaattaa

SEQ ID NO: 404 - skipped

SEQ ID NO: 405 - DNA, 474 bp, Artificial Sequence
  Human glutaredoxin 5 (hGRX5)
atgagcgggtccctcggccgagctgcggcggctctgctccgctgggggcgcggcgcgggcggcggtggcctttggggtccgggcgtgcgggcggcgggctcgggcgcgggcggcggcggctcggcggagcagttggacgcgctggtgaagaaggacaaggtggtggtcttcctcaaggggacgccggagcagccccagtgcggcttcagcaacgccgtggtgcagatcctgcggctgcacggcgtccgcgattacgcggcctacaacgtgctggacgacccggagctccgacaaggcattaaagactattccaactggcccaccatcccgcaagtgtacctcaatggcgagtttgtagggggctgtgacattcttctgcagatgcaccagaatggggacttggtggaagaactgaaaaagctggggatccactccacccttttagatgaaaagaaagaccaagactccaagtga

SEQ ID NO: 406-410 - skipped (5 entries)

SEQ ID NO: 411 - DNA, 324 bp, Artificial Sequence
  Mouse glutaredoxin 1 (mGRX1)
atggctcaggagtttgtgaactgcaagatccagtctgggaaggtggtcgtgttcatcaagcccacctgcccctactgcagaaagacccaagaaatcctcagtcaactgcctttcaaacaaggtcttctggagtttgtggacatcacagccactaacaacaccagtgcgattcaagattatttacaacagctcaccggagcgagaacagttcctcgggtcttcataggtaaagactgcataggcggatgcagtgatctaatctccatgcaacagactggggagctgatgactcggctgaagcagattggagctctgcagttataa

SEQ ID NO: 412-421 - skipped (10 entries)

SEQ ID NO: 422 - DNA, 321 bp, Artificial Sequence
  Functional human GRX1 variant 2 (hGRX1v2) -EFVA- mutant
atggctcaagagtttgtgaactgcaaaatccagcctgggaaggtggttgtgttcatcaagcccacctgcccgtactgcaggagggcccaagagatcctcagtcaattgcccatcaaacaagggcttctggaatttgtcgctatcacagccaccaaccacactaacgagattcaagattatttgcaacagctcacgggagcaagaacggtgcctcgagtctttattggtaaagattgtataggcggatgcagtgatctagtctctttgcaacagagtggggaactgctgacgcggctaaagcagattggagctctgcagtag

SEQ ID NO: 423-431 - skipped (9 entries)

SEQ ID NO: 432 - DNA, 321 bp, Artificial Sequence
  Functional human GRX1 variant 12 (hGRX1v2) -C7S C79S C83S- mutant
atggctcaagagtttgtgaacagcaaaatccagcctgggaaggtggttgtgttcatcaagcccacctgcccgtactgcaggagggcccaagagatcctcagtcaattgcccatcaaacaagggcttctggaatttgtcgatatcacagccaccaaccacactaacgagattcaagattatttgcaacagctcacgggagcaagaacggtgcctcgagtctttattggtaaagattctataggcggatccagtgatctagtctctttgcaacagagtggggaactgctgacgcggctaaagcagattggagctctgcagtag

SEQ ID NO: 433-440 - skipped (8 entries)

SEQ ID NO: 441 - DNA, 633 bp, Artificial Sequence
  Human glutathione S-transferase P(hGSTP)
atgccgccctacaccgtggtctatttcccagttcgaggccgctgcgcggccctgcgcatgctgctggcagatcagggccagagctggaaggaggaggtggtgaccgtggagacgtggcaggagggctcactcaaagcctcctgcctatacgggcagctccccaagttccaggacggagacctcaccctgtaccagtccaataccatcctgcgtcacctgggccgcacccttgggctctatgggaaggaccagcaggaggcagccctggtggacatggtgaatgacggcgtggaggacctccgctgcaaatacgtctccctcatctacaccaactatgaggcgggcaaggatgactatgtgaaggcactgcccgggcaactgaagccttttgagaccctgctgtcccagaaccagggaggcaagaccttcattgtgggagaccagatctccttcgctgactacaacctgctggacttgctgctgatccatgaggtcctagcccctggctgcctggatgcgttccccctgctctcagcatatgtggggcgcctcagcgcccggcccaagctcaaggccttcctggcctcccctgagtacgtgaacctccccatcaatggcaacgggaaacagtga

SEQ ID NO: 442-450 - skipped (9 entries)

SEQ ID NO: 451 - DNA, 633 bp, Artificial Sequence
  Mouse glutathione S-transferase P (mGSTP)
atgccaccatacaccattgtctacttcccagttcgagggcggtgtgaggccatgcgaatgctgctggctgaccagggccagagctggaaggaggaggtggttaccatagatacctggatgcaaggcttgctcaagcccacttgtctgtatgggcagctccccaagtttgaggatggagacctcaccctttaccaatctaatgccatcttgagacaccttggccgctctttggggctttatgggaaaaaccagagggaggccgcccagatggatatggtgaatgatggggtggaggaccttcgcggcaaatatgtcaccctcatctacaccaactatgagaatggtaagaatgactacgtgaaggccctgcctgggcatctgaagccttttgagaccctgctgtcccagaaccagggaggcaaagctttcatcgtgggtgaccagatctcctttgccgattacaacttgctggacctgctgctgatccaccaagtcctggcccctggctgcctggacaacttccccctgctctctgcctatgtggctcgcctcagtgcccggcccaagatcaaggcctttctgtcctccccggaacatgtgaaccgtcccatcaatggcaatggcaaacagtag

SEQ ID NO: 452-577 - skipped (126 entries)

SEQ ID NO: 578 - protein, 348 aa, Artificial Sequence
  LS-NbMMRm22.84-CD28H-CD28TM-CD28CS-CD3zICS
MEWTWVFLFLLSVTAGVHSQVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 579 - protein, 349 aa, Artificial Sequence
  LS-NbMMRm5.38-CD28H-CD28TM-CD28CS-CD3zICS
MEWTWVFLFLLSVTAGVHSQVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 580 - protein, 465 aa, Artificial Sequence
  LS-scFvP4A8VHVL-CD28H-CD28TM-CD28CS-CD3zICS
MEWTWVFLFLLSVTAGVHSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 581 - protein, 465 aa, Artificial Sequence
  LS-scFvP4A8VLVH-CD28H-CD28TM-CD28CS-CD3zICS
MEWTWVFLFLLSVTAGVHSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 582 - protein, 465 aa, Artificial Sequence
  LS-scFvP3G5VHVL-CD28H-CD28TM-CD28CS-CD3zICS
MEWTWVFLFLLSVTAGVHSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 583 - protein, 465 aa, Artificial Sequence
  LS-scFvP3G5VLVH-CD28H-CD28TM-CD28CS-CD3zICS
MEWTWVFLFLLSVTAGVHSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVSKRSRLLHSDYMNMTPRRPGPTRKHYQPYAPPRDFAAYRSLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 584 - protein, 350 aa, Artificial Sequence
  LS-NbMMRm22.84-CD28H-CD28TM-41BBCS-CD3zICS
MEWTWVFLFLLSVTAGVHSQVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 585 - protein, 351 aa, Artificial Sequence
  LS-NbMMRm5.38-CD28H-CD28TM-41BBCS-CD3zICS
MEWTWVFLFLLSVTAGVHSQVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 586 - protein, 467 aa, Artificial Sequence
  LS-scFvP4A8VHVL-CD28H-CD28TM-41BBCS-CD3zICS
MEWTWVFLFLLSVTAGVHSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 587 - protein, 467 aa, Artificial Sequence
  LS-scFvP4A8VLVH-CD28H-CD28TM-41BBCS-CD3zICS
MEWTWVFLFLLSVTAGVHSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 588 - protein, 467 aa, Artificial Sequence
  LS-scFvP3G5VHVL-CD28H-CD28TM-41BBCS-CD3zICS
MEWTWVFLFLLSVTAGVHSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 589 - protein, 467 aa, Artificial Sequence
  LS-scFvP3G5VLVH-CD28H-CD28TM-41BBCS-CD3zICS
MEWTWVFLFLLSVTAGVHSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVKRGRKKLLYIFKQPFMRPVQTTQEEDGCSCRFPEEEEGGCELLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 590 - protein, 332 aa, Artificial Sequence
  LS-NbMMRm22.84-CD28H-CD28TM-DAP10CS-CD3zICS
MEWTWVFLFLLSVTAGVHSQVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 591 - protein, 333 aa, Artificial Sequence
  LS-NbMMRm5.38-CD28H-CD28TM-DAP10CS-CD3zICS
MEWTWVFLFLLSVTAGVHSQVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 592 - protein, 449 aa, Artificial Sequence
  LS-scFvP4A8VHVL-CD28H-CD28TM-DAP10CS-CD3zICS
MEWTWVFLFLLSVTAGVHSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 593 - protein, 449 aa, Artificial Sequence
  LS-scFvP4A8VLVH-CD28H-CD28TM-DAP10CS-CD3zICS
MEWTWVFLFLLSVTAGVHSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 594 - protein, 449 aa, Artificial Sequence
  LS-scFvP3G5VHVL-CD28H-CD28TM-DAP10CS-CD3zICS
MEWTWVFLFLLSVTAGVHSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 595 - protein, 449 aa, Artificial Sequence
  LS-scFvP3G5VLVH-CD28H-CD28TM-DAP10CS-CD3zICS
MEWTWVFLFLLSVTAGVHSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSVKGKHLCPSPLFPGPSKPFWVLVVVGGVLACYSLLVTVAFIIFWVLCARPRRSPAQEDGKVYINMPGRGLRVKFSRSADAPAYQQGQNQLYNELNLGRREEYDVLDKRRGRDPEMGGKPQRRKNPQEGLYNELQKDKMAEAYSEIGMKGERRRGKGHDGLYQGLSTATKDTYDALHMQALPPR

SEQ ID NO: 596-677 - skipped (82 entries)

SEQ ID NO: 678 - DNA, 1047 bp, Artificial Sequence
  LS-NbMMRm22.84-CD28H-CD28TM-CD28CS-CD3zICS
atggagtggacctgggtgttcctgttcctgctgagcgtgaccgccggcgtgcacagccaggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 679 - DNA, 1050 bp, Artificial Sequence
  LS-NbMMRm5.38-CD28H-CD28TM-CD28CS-CD3zICS
atggagtggacctgggtgttcctgttcctgctgagcgtgaccgccggcgtgcacagccaggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 680 - DNA, 1398 bp, Artificial Sequence
  LS-scFvP4A8VHVL-CD28H-CD28TM-CD28CS-CD3zICS
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 681 - DNA, 1398 bp, Artificial Sequence
  LS-scFvP4A8VLVH-CD28H-CD28TM-CD28CS-CD3zICS
atggagtggacctgggtgttcctgttcctgctgagcgtgaccgccggcgtgcacagcgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 682 - DNA, 1398 bp, Artificial Sequence
  LS-scFvP3G5VHVL-CD28H-CD28TM-CD28CS-CD3zICS
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 683 - DNA, 1398 bp, Artificial Sequence
  LS-scFvP3G5VLVH-CD28H-CD28TM-CD28CS-CD3zICS
atggagtggacctgggtgttcctgttcctgctgagcgtgaccgccggcgtgcacagcgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaggagtaagaggagcaggctcctgcacagtgactacatgaacatgactccccgccgccccgggcccacccgcaagcattaccagccctatgccccaccacgcgacttcgcagcctatcgctcccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 684 - DNA, 1050 bp, Artificial Sequence
  LS-NbMMRm22.84-CD28H-CD28TM-41BBCS-CD3zICS
atggagtggacctgggtgttcctgttcctgctgagcgtgaccgccggcgtgcacagccaggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 685 - DNA, 1053 bp, Artificial Sequence
  LS-NbMMRm5.38-CD28H-CD28TM-41BBCS-CD3zICS
atggagtggacctgggtgttcctgttcctgctgagcgtgaccgccggcgtgcacagccaggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 686 - DNA, 1401 bp, Artificial Sequence
  LS-scFvP4A8VHVL-CD28H-CD28TM-41BBCS-CD3zICS
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 687 - DNA, 1401 bp, Artificial Sequence
  LS-scFvP4A8VLVH-CD28H-CD28TM-41BBCS-CD3zICS
atggagtggacctgggtgttcctgttcctgctgagcgtgaccgccggcgtgcacagcgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 688 - DNA, 1401 bp, Artificial Sequence
  LS-scFvP3G5VHVL-CD28H-CD28TM-41BBCS-CD3zICS
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 689 - DNA, 1401 bp, Artificial Sequence
  LS-scFvP3G5VLVH-CD28H-CD28TM-41BBCS-CD3zICS
atggagtggacctgggtgttcctgttcctgctgagcgtgaccgccggcgtgcacagcgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgaaacggggcagaaagaaactcctgtatatattcaaacaaccatttatgagaccagtacaaactactcaagaggaagatggctgtagctgccgatttccagaagaagaagaaggaggatgtgaactgcttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 690 - DNA, 996 bp, Artificial Sequence
  LS-NbMMRm22.84-CD28H-CD28TM-DAP10CS-CD3zICS
atggagtggacctgggtgttcctgttcctgctgagcgtgaccgccggcgtgcacagccaggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctgtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 691 - DNA, 999 bp, Artificial Sequence
  LS-NbMMRm5.38-CD28H-CD28TM-DAP10CS-CD3zICS
atggagtggacctgggtgttcctgttcctgctgagcgtgaccgccggcgtgcacagccaggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctgtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 692 - DNA, 1347 bp, Artificial Sequence
  LS-scFvP4A8VHVL-CD28H-CD28TM-DAP10CS-CD3zICS
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 693 - DNA, 1347 bp, Artificial Sequence
  LS-scFvP4A8VLVH-CD28H-CD28TM-DAP10CS-CD3zICS
atggagtggacctgggtgttcctgttcctgctgagcgtgaccgccggcgtgcacagcgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 694 - DNA, 1347 bp, Artificial Sequence
  LS-scFvP3G5VHVL-CD28H-CD28TM-DAP10CS-CD3zICS
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 695 - DNA, 1347 bp, Artificial Sequence
  LS-scFvP3G5VLVH-CD28H-CD28TM-DAP10CS-CD3zICS
atggagtggacctgggtgttcctgttcctgctgagcgtgaccgccggcgtgcacagcgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcagtgaaagggaaacacctttgtccaagtcccctatttcccggaccttctaagcccttttgggtgctggtggtggttggtggagtcctggcttgctatagcttgctagtaacagtggcctttattattttctgggtgctgtgcgcacgcccacgccgcagccccgcccaagaagatggcaaagtctacatcaacatgccaggcaggggccttagagtgaagttcagcaggagcgcagacgcccccgcgtaccagcagggccagaaccagctctataacgagctcaatctaggacgaagagaggagtacgatgttttggacaagagacgtggccgggaccctgagatggggggaaagccgcagagaaggaagaaccctcaggaaggcctgtacaatgaactgcagaaagataagatggcggaggcctacagtgagattgggatgaaaggcgagcgccggaggggcaaggggcacgatggcctttaccagggtctcagtacagccaccaaggacacctacgacgcccttcacatgcaggccctgccccctcgc

SEQ ID NO: 696-700 - skipped (5 entries)

SEQ ID NO: 701 - protein, 1456 aa, Artificial Sequence
  Mouse CD206
MRLLLLLAFISVIPVSVQLLDARQFLIYNEDHKRCVDALSAISVQTATCNPEAESQKFRWVSDSQIMSVAFKLCLGVPSKTDWASVTLYACDSKSEYQKWECKNDTLFGIKGTELYFNYGNRQEKNIKLYKGSGLWSRWKVYGTTDDLCSRGYEAMYSLLGNANGAVCAFPFKFENKWYADCTSAGRSDGWLWCGTTTDYDKDKLFGFCPLHFEGSERLWNKDPLTGILYQINSKSALTWHQARASCKQQNADLLSVTEIHEQMYLTGLTSSLSSGLWIGLNSLSVRSGWQWAGGSPFRYLNWLPGSPSSEPGKSCVSLNPGKNAKWENLECVQKLGYICKKGNNTLNPFIIPSASDVPTGCPNQWWPYAGHCYRIHREEKKIQKYALQACRKEGGDLASIHSIEEFDFIFSQLGYEPNDELWIGLNDIKIQMYFEWSDGTPVTFTKWLPGEPSHENNRQEDCVVMKGKDGYWADRACEQPLGYICKMVSQSHAVVPEGADKGCRKGWKRHGFYCYLIGSTLSTFTDANHTCTNEKAYLTTVEDRYEQAFLTSLVGLRPEKYFWTGLSDVQNKGTFRWTVDEQVQFTHWNADMPGRKAGCVAMKTGVAGGLWDVLSCEEKAKFVCKHWAEGVTRPPEPTTTPEPKCPENWGTTSKTSMCFKLYAKGKHEKKTWFESRDFCKAIGGELASIKSKDEQQVIWRLITSSGSYHELFWLGLTYGSPSEGFTWSDGSPVSYENWAYGEPNNYQNVEYCGELKGDPGMSWNDINCEHLNNWICQIQKGKTLLPEPTPAPQDNPPVTADGWVIYKDYQYYFSKEKETMDNARAFCKKNFGDLATIKSESEKKFLWKYINKNGGQSPYFIGMLISMDKKFIWMDGSKVDFVAWATGEPNFANDDENCVTMYTNSGFWNDINCGYPNNFICQRHNSSINATAMPTTPTTPGGCKEGWHLYKNKCFKIFGFANEEKKSWQDARQACKGLKGNLVSIENAQEQAFVTYHMRDSTFNAWTGLNDINAEHMFLWTAGQGVHYTNWGKGYPGGRRSSLSYEDADCVVVIGGNSREAGTWMDDTCDSKQGYICQTQTDPSLPVSPTTTPKDGFVTYGKSSYSLMKLKLPWHEAETYCKDHTSLLASILDPYSNAFAWMKMHPFNVPIWIALNSNLTNNEYTWTDRWRVRYTNWGADEPKLKSACVYMDVDGYWRTSYCNESFYFLCKKSDEIPATEPPQLPGKCPESEQTAWIPFYGHCYYFESSFTRSWGQASLECLRMGASLVSIETAAESSFLSYRVEPLKSKTNFWIGMFRNVEGKWLWLNDNPVSFVNWKTGDPSGERNDCVVLASSSGLWNNIHCSSYKGFICKMPKIIDPVTTHSSITTKADQRKMDPQPKGSSKAAGVVTVVLLIVIGAGVAAYFFYKKRHALHIPQEATFENTLYFNSNLSPGTSDTKDLMGNIEQNEHAII

SEQ ID NO: 702 - protein, 1159 aa, Artificial Sequence
  Mouse CD163
MGGHRMVLLGGAGSPGCKRFVHLGFFVVAVSSLLSASAVTNAPGEMKKELRLAGGENNCSGRVELKIHDKWGTVCSNGWSMNEVSVVCQQLGCPTSIKALGWANSSAGSGYIWMDKVSCTGNESALWDCKHDGWGKHNCTHEKDAGVTCSDGSNLEMRLVNSAGHRCLGRVEIKFQGKWGTVCDDNFSKDHASVICKQLGCGSAISFSGSAKLGAGSGPIWLDDLACNGNESALWDCKHRGWGKHNCDHAEDVGVICLEGADLSLRLVDGVSRCSGRLEVRFQGEWGTVCDDNWDLRDASVVCKQLGCPTAISAIGRVNASEGSGQIWLDNISCEGHEATLWECKHQEWGKHYCHHREDAGVTCSDGADLELRLVGGGSRCAGIVEVEIQKLTGKMCSRGWTLADADVVCRQLGCGSALQTQAKIYSKTGATNTWLFPGSCNGNETTFWQCKNWQWGGLSCDNFEEAKVTCSGHREPRLVGGEIPCSGRVEVKHGDVWGSVCDFDLSLEAASVVCRELQCGTVVSILGGAHFGEGSGQIWGEEFQCSGDESHLSLCSVAPPLDRTCTHSRDVSVVCSRYIDIRLAGGESSCEGRVELKTLGAWGPLCSSHWDMEDAHVLCQQLKCGVAQSIPEGAHFGKGAGQVWSHMFHCTGTEEHIGDCLMTALGAPTCSEGQVASVICSGNQSQTLLPCSSLSPVQTTSSTIPKESEVPCIASGQLRLVGGGGRCAGRVEVYHEGSWGTVCDDNWDMTDANVVCKQLDCGVAINATGSAYFGEGAGAIWLDEVICTGKESHIWQCHSHGWGRHNCRHKEDAGVICSEFMSLRLTNEAHKENCTGRLEVFYNGTWGSIGSSNMSPTTVGVVCRQLGCADNGTVKPIPSDKTPSRPMWVDRVQCPKGVDTLWQCPSSPWKQRQASPSSQESWIICDNKIRLQEGHTDCSGRVEIWHKGSWGTVCDDSWDLNDAKVVCKQLGCGQAVKALKEAAFGPGTGPIWLNEIKCRGNESSLWDCPAKPWSHSDCGHKEDASIQCLPKMTSESHHGTGHPTLTALLVCGAILLVLLIVFLLWTLKRRQIQRLTVSSRGEVLIHQVQYQEMDSKADDLDLLKSSENSNNSYDFNDDGLTSLSKYLPISGIKKGSFRGTLRRKMIIYNPLRLEFKKP

SEQ ID NO: 703 - protein, 129 aa, Artificial Sequence
  Mouse Fn14
MASAWPRSLPQILVLGFGLVLMRAAAGEQAPGTSPCSSGSSWSADLDKCMDCASCPARPHSDFCLGCAAAPPAHFRLLWPILGGALSLVLVLALVSSFLVWRRCRRREKFTTPIEETGGEGCPGVALIQ

SEQ ID NO: 704-744 - skipped (41 entries)

SEQ ID NO: 745 - protein, 15 aa, Artificial Sequence
  Mouse CD28 hinge (mCD28H)
IKEKHLCHTQSSPKL

SEQ ID NO: 746 - protein, 27 aa, Artificial Sequence
  Mouse CD28 transmembrane domain (mCD28TM)
FWALVVVAGVLFCYGLLVTVALCVIWT

SEQ ID NO: 747 - protein, 113 aa, Artificial Sequence
  Mouse CD3 zeta intracellular signaling domain (mCD3zICS)
RAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 748-750 - skipped (3 entries)

SEQ ID NO: 751 - protein, 325 aa, Artificial Sequence
  Mouse truncated CD19 (mtrCD19)
MPSPLPVSFLLFLTLVGGRPQKSLLVEVEEGGNVVLPCLPDSSPVSSEKLAWYRGNQSTPFLELSPGSPGLGLHVGSLGILLVIVNVSDHMGGFYLCQKRPPFKDIWQPAWTVNVEDSGEMFRWNASDVRDLDCDLRNRSSGSHRSTSGSQLYVWAKDHPKVWGTKPVCAPRGSSLNQSLINQDLTVAPGSTLWLSCGVPPVPVAKGSISWTHVHPRRPNVSLLSLSLGGEHPVREMWVWGSLLLLPQATALDEGTYYCLRGNLTIERHVKVIARSAVWLWLLRTGGWIVPVVTLVYVIFCMVSLVAFLYCQRAFILRRKRKRMT

SEQ ID NO: 752-755 - skipped (4 entries)

SEQ ID NO: 756 - protein, 41 aa, Artificial Sequence
  Mouse CD28 costimulatory domain (mCD28CS)
NSRRNRLLQSDYMNMTPRRPGLTRKPYQPYAPARDFAAYRP

SEQ ID NO: 757-759 - skipped (3 entries)

SEQ ID NO: 760 - protein, 326 aa, Artificial Sequence
  NbMMRm22.84-mCD28H-mCD28TM-mCD28CS-mCD3zICS
QVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 761 - protein, 327 aa, Artificial Sequence
  NbMMRm5.38-mCD28H-mCD28TM-mCD28CS-mCD3zICS
QVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 762 - protein, 443 aa, Artificial Sequence
  scFvP4A8VHVL-mCD28H-mCD28TM-mCD28CS-mCD3zICS
QVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 763 - protein, 443 aa, Artificial Sequence
  scFvP4A8VLVH-mCD28H-mCD28TM-mCD28CS-mCD3zICS
DIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 764 - protein, 443 aa, Artificial Sequence
  scFvP3G5VHVL-mCD28H-mCD28TM-mCD28CS-mCD3zICS
QVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 765 - protein, 443 aa, Artificial Sequence
  scFvP3G5VLVH-mCD28H-mCD28TM-mCD28CS-mCD3zICS
DIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPR

SEQ ID NO: 766 - protein, 402 aa, Artificial Sequence
  mCD3zICS-mCD28CS-mTWEAK
RAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPRNSRRNRLLQSDYMNMTPRRPGLTRKPYQPYAPARDFAAYRPAARRSQRRRGRRGEPGTALLAPLVLSLGLALACLGLLLVVVSLGSWATLSAQEPSQEELTAEDRREPPELNPQTEESQDVVPFLEQLVRPRRSAPKGRKARPRRAIAAHYEVHPRPGQDGAQAGVDGTVSGWEETKINSSSPLRYDRQIGEFTVIRAGLYYLYCQVHFDEGKAVYLKLDLLVNGVLALRCLEEFSATAASSPGPQLRLCQVSGLLPLRPGSSLRIRTLPWAHLKAAPFLTYFGLFQVH

SEQ ID NO: 767-777 - skipped (11 entries)

SEQ ID NO: 778 - protein, 697 aa, Artificial Sequence
  LS-NbMMRm22.84-mCD28H-mCD28TM-mCD28CS-mCD3zICS-T2A-mtrCD19
MEWTWVFLFLLSVTAGVHSQVQLQESGGGLVQPGGSLRLSCAASGRTFSNYVNYAMGWFRQFPGKEREFVASISWSSVTTYYADSVKGRFTISRDNAKNTVYLQMNSLKPEDTAVYYCAAHLAQYSDYAYRDPHQFGAWGQGTQVTVSSIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPRARAKRSGSGEGRGSLLTCGDVEENPGPMPSPLPVSFLLFLTLVGGRPQKSLLVEVEEGGNVVLPCLPDSSPVSSEKLAWYRGNQSTPFLELSPGSPGLGLHVGSLGILLVIVNVSDHMGGFYLCQKRPPFKDIWQPAWTVNVEDSGEMFRWNASDVRDLDCDLRNRSSGSHRSTSGSQLYVWAKDHPKVWGTKPVCAPRGSSLNQSLINQDLTVAPGSTLWLSCGVPPVPVAKGSISWTHVHPRRPNVSLLSLSLGGEHPVREMWVWGSLLLLPQATALDEGTYYCLRGNLTIERHVKVIARSAVWLWLLRTGGWIVPVVTLVYVIFCMVSLVAFLYCQRAFILRRKRKRMT

SEQ ID NO: 779 - protein, 698 aa, Artificial Sequence
  LS-NbMMRm5.38-mCD28H-mCD28TM-mCD28CS-mCD3zICS-T2A-mtrCD19
MEWTWVFLFLLSVTAGVHSQVQLQESGGGLVQAGGSLRLSCAASGFTDDDYDIGWFRQAPGKEREGVSCISSSDGSTYYADSVKGRFTISSDNAKNTVYLQMNSLKPEDTAVYYCAADFFRWDSGSYYVRGCRHATYDYWGQGTQVTVSSIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPRARAKRSGSGEGRGSLLTCGDVEENPGPMPSPLPVSFLLFLTLVGGRPQKSLLVEVEEGGNVVLPCLPDSSPVSSEKLAWYRGNQSTPFLELSPGSPGLGLHVGSLGILLVIVNVSDHMGGFYLCQKRPPFKDIWQPAWTVNVEDSGEMFRWNASDVRDLDCDLRNRSSGSHRSTSGSQLYVWAKDHPKVWGTKPVCAPRGSSLNQSLINQDLTVAPGSTLWLSCGVPPVPVAKGSISWTHVHPRRPNVSLLSLSLGGEHPVREMWVWGSLLLLPQATALDEGTYYCLRGNLTIERHVKVIARSAVWLWLLRTGGWIVPVVTLVYVIFCMVSLVAFLYCQRAFILRRKRKRMT

SEQ ID NO: 780 - protein, 814 aa, Artificial Sequence
  LS-scFvP4A8VHVL-mCD28H-mCD28TM-mCD28CS-mCD3zICS-T2A-mtrCD19
MEWTWVFLFLLSVTAGVHSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPRARAKRSGSGEGRGSLLTCGDVEENPGPMPSPLPVSFLLFLTLVGGRPQKSLLVEVEEGGNVVLPCLPDSSPVSSEKLAWYRGNQSTPFLELSPGSPGLGLHVGSLGILLVIVNVSDHMGGFYLCQKRPPFKDIWQPAWTVNVEDSGEMFRWNASDVRDLDCDLRNRSSGSHRSTSGSQLYVWAKDHPKVWGTKPVCAPRGSSLNQSLINQDLTVAPGSTLWLSCGVPPVPVAKGSISWTHVHPRRPNVSLLSLSLGGEHPVREMWVWGSLLLLPQATALDEGTYYCLRGNLTIERHVKVIARSAVWLWLLRTGGWIVPVVTLVYVIFCMVSLVAFLYCQRAFILRRKRKRMT

SEQ ID NO: 781 - protein, 814 aa, Artificial Sequence
  LS-scFvP4A8VLVH-mCD28H-mCD28TM-mCD28CS-mCD3zICS-T2A-mtrCD19
MEWTWVFLFLLSVTAGVHSDIVLTQSPASLAVSLGQRATISCRASKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGMHWVKQSHAKSLEWIGVISTYNGYTNYNQKFKGKATMTVDKSSSTAYMELARLTSEDSAIYYCARAYYGNLYYAMDYWGQGTSVTVSSIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPRARAKRSGSGEGRGSLLTCGDVEENPGPMPSPLPVSFLLFLTLVGGRPQKSLLVEVEEGGNVVLPCLPDSSPVSSEKLAWYRGNQSTPFLELSPGSPGLGLHVGSLGILLVIVNVSDHMGGFYLCQKRPPFKDIWQPAWTVNVEDSGEMFRWNASDVRDLDCDLRNRSSGSHRSTSGSQLYVWAKDHPKVWGTKPVCAPRGSSLNQSLINQDLTVAPGSTLWLSCGVPPVPVAKGSISWTHVHPRRPNVSLLSLSLGGEHPVREMWVWGSLLLLPQATALDEGTYYCLRGNLTIERHVKVIARSAVWLWLLRTGGWIVPVVTLVYVIFCMVSLVAFLYCQRAFILRRKRKRMT

SEQ ID NO: 782 - protein, 814 aa, Artificial Sequence
  LS-scFvP3G5VHVL-mCD28H-mCD28TM-mCD28CS-mCD3zICS-T2A-mtrCD19
MEWTWVFLFLLSVTAGVHSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSGGGGSGGGGSGGGGSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPRARAKRSGSGEGRGSLLTCGDVEENPGPMPSPLPVSFLLFLTLVGGRPQKSLLVEVEEGGNVVLPCLPDSSPVSSEKLAWYRGNQSTPFLELSPGSPGLGLHVGSLGILLVIVNVSDHMGGFYLCQKRPPFKDIWQPAWTVNVEDSGEMFRWNASDVRDLDCDLRNRSSGSHRSTSGSQLYVWAKDHPKVWGTKPVCAPRGSSLNQSLINQDLTVAPGSTLWLSCGVPPVPVAKGSISWTHVHPRRPNVSLLSLSLGGEHPVREMWVWGSLLLLPQATALDEGTYYCLRGNLTIERHVKVIARSAVWLWLLRTGGWIVPVVTLVYVIFCMVSLVAFLYCQRAFILRRKRKRMT

SEQ ID NO: 783 - protein, 814 aa, Artificial Sequence
  LS-scFvP3G5VLVH-mCD28H-mCD28TM-mCD28CS-mCD3zICS-T2A-mtrCD19
MEWTWVFLFLLSVTAGVHSDIVLTQSPASLAVSLGQRATISCRANKSVSTSSYSYMHWYQQKPGQPPKLLIKYASNLESGVPARFSGSGSGTDFILNIHPVEEEDAATYYCQHSRELPFTFGSGTKLEIKGGGGSGGGGSGGGGSQVQLQQSGPEVVRPGVSVKISCKGSGYTFTDYGIHWVKQSHAKSLEWIGVISTYNGYTNYNQKFKGKATMTVDKSSSTAYMELARLTSEDSAIYYCARAYYGNLYYAMDYWGQGTSVTVSSIKEKHLCHTQSSPKLFWALVVVAGVLFCYGLLVTVALCVIWTNSRRNRLLQSDYMNMTPRRPGLTRKPYQPYAPARDFAAYRPRAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPRARAKRSGSGEGRGSLLTCGDVEENPGPMPSPLPVSFLLFLTLVGGRPQKSLLVEVEEGGNVVLPCLPDSSPVSSEKLAWYRGNQSTPFLELSPGSPGLGLHVGSLGILLVIVNVSDHMGGFYLCQKRPPFKDIWQPAWTVNVEDSGEMFRWNASDVRDLDCDLRNRSSGSHRSTSGSQLYVWAKDHPKVWGTKPVCAPRGSSLNQSLINQDLTVAPGSTLWLSCGVPPVPVAKGSISWTHVHPRRPNVSLLSLSLGGEHPVREMWVWGSLLLLPQATALDEGTYYCLRGNLTIERHVKVIARSAVWLWLLRTGGWIVPVVTLVYVIFCMVSLVAFLYCQRAFILRRKRKRMT

SEQ ID NO: 784 - protein, 754 aa, Artificial Sequence
  mCD3zICS-mCD28CS-mTWEAK-T2A-mtrCD19
RAKFSRSAETAANLQDPNQLYNELNLGRREEYDVLEKKRARDPEMGGKQQRRRNPQEGVYNALQKDKMAEAYSEIGTKGERRRGKGHDGLYQGLSTATKDTYDALHMQTLAPRNSRRNRLLQSDYMNMTPRRPGLTRKPYQPYAPARDFAAYRPAARRSQRRRGRRGEPGTALLAPLVLSLGLALACLGLLLVVVSLGSWATLSAQEPSQEELTAEDRREPPELNPQTEESQDVVPFLEQLVRPRRSAPKGRKARPRRAIAAHYEVHPRPGQDGAQAGVDGTVSGWEETKINSSSPLRYDRQIGEFTVIRAGLYYLYCQVHFDEGKAVYLKLDLLVNGVLALRCLEEFSATAASSPGPQLRLCQVSGLLPLRPGSSLRIRTLPWAHLKAAPFLTYFGLFQVHARAKRSGSGEGRGSLLTCGDVEENPGPMPSPLPVSFLLFLTLVGGRPQKSLLVEVEEGGNVVLPCLPDSSPVSSEKLAWYRGNQSTPFLELSPGSPGLGLHVGSLGILLVIVNVSDHMGGFYLCQKRPPFKDIWQPAWTVNVEDSGEMFRWNASDVRDLDCDLRNRSSGSHRSTSGSQLYVWAKDHPKVWGTKPVCAPRGSSLNQSLINQDLTVAPGSTLWLSCGVPPVPVAKGSISWTHVHPRRPNVSLLSLSLGGEHPVREMWVWGSLLLLPQATALDEGTYYCLRGNLTIERHVKVIARSAVWLWLLRTGGWIVPVVTLVYVIFCMVSLVAFLYCQRAFILRRKRKRMT

SEQ ID NO: 785-844 - skipped (60 entries)

SEQ ID NO: 845 - DNA, 45 bp, Artificial Sequence
  Mouse CD28 hinge (mCD28H)
atcaaggagaagcacctgtgccacacccagagcagccccaagctg

SEQ ID NO: 846 - DNA, 81 bp, Artificial Sequence
  Mouse CD28 transmembrane domain (mCD28TM)
ttctgggccctggtggtggtggccggcgtgctgttctgctacggcctgctggtgaccgtggccctgtgcgtgatctggacc

SEQ ID NO: 847 - DNA, 339 bp, Artificial Sequence
  Mouse CD3 zeta intracellular signaling domain (mCD3zICS)
agggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagg

SEQ ID NO: 848-850 - skipped (3 entries)

SEQ ID NO: 851 - DNA, 981 bp, Artificial Sequence
  Mouse truncated CD19 (mtrCD19)
atgccatctcctctgcctgtgtccttcctgctgttcctgacactcgtcggcggcagacctcagaagtctctgctggttgaggtggaagagggcggcaatgtggtgctgccttgtctgcctgatagcagccctgtgtccagcgagaagctggcttggtacagaggcaaccagagcaccccatttctggaactgagccctggctctcctggactgggactgcatgttggatctctgggcatcctgctggtcatcgtgaacgtgtccgatcacatgggcggcttctacctgtgccagaagaggcctccattcaaggacatctggcagcctgcctggaccgtgaacgttgaggatagcggcgagatgttcagatggaacgccagcgacgtgcgcgacctggactgtgacctgagaaacagaagcagcggcagccacagaagcacctctggctctcagctgtacgtgtgggccaaagatcaccccaaagtgtggggcaccaagcctgtgtgtgctcctagaggcagcagcctgaaccagagcctgatcaaccaggacctgacagtggctcctggcagcacactgtggctgtcttgcggagttcctccagtgcctgtggccaagggcagcatctcttggacacacgtgcaccctagaaggcccaacgtgtccctgctgtctctgtctctcggcggagaacatcccgtgcgcgagatgtgggtttggggatctcttctgctgctgccacaggccacagctctggatgagggcacctactactgcctgaggggcaacctgaccatcgagagacacgtgaaagtgatcgccagatccgccgtgtggctctggcttcttagaacaggcggatggatcgtgcccgtggtcaccctggtgtacgtgatcttctgcatggtgtccctggtggccttcctgtactgccagagagccttcatcctgagaagaaagcgcaagcggatgacctgatga

SEQ ID NO: 852-855 - skipped (4 entries)

SEQ ID NO: 856 - DNA, 123 bp, Artificial Sequence
  Mouse CD28 costimulatory domain (mCD28CS)
aacagcaggaggaacaggctgctgcagagcgactacatgaacatgacccccaggaggcccggcctgaccaggaagccctaccagccctacgcccccgccagggacttcgccgcctacaggccc

SEQ ID NO: 857-859 - skipped (3 entries)

SEQ ID NO: 860 - DNA, 978 bp, Artificial Sequence
  NbMMRm22.84-mCD28H-mCD28TM-mCD28CS-mCD3zICS
caggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagg

SEQ ID NO: 861 - DNA, 981 bp, Artificial Sequence
  NbMMRm5.38-mCD28H-mCD28TM-mCD28CS-mCD3zICS
caggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagg

SEQ ID NO: 862 - DNA, 1329 bp, Artificial Sequence
  scFvP4A8VHVL-mCD28H-mCD28TM-mCD28CS-mCD3zICS
caggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagg

SEQ ID NO: 863 - DNA, 1329 bp, Artificial Sequence
  scFvP4A8VLVH-mCD28H-mCD28TM-mCD28CS-mCD3zICS
gacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagg

SEQ ID NO: 864 - DNA, 1329 bp, Artificial Sequence
  scFvP3G5VHVL-mCD28H-mCD28TM-mCD28CS-mCD3zICS
caggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagg

SEQ ID NO: 865 - DNA, 1329 bp, Artificial Sequence
  scFvP3G5VLVH-mCD28H-mCD28TM-mCD28CS-mCD3zICS
gacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagg

SEQ ID NO: 866 - DNA, 1209 bp, Artificial Sequence
  mCD3zICS-mCD28CS-mTWEAK
agggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccaggaacagcaggaggaacaggctgctgcagagcgactacatgaacatgacccccaggaggcccggcctgaccaggaagccctaccagccctacgcccccgccagggacttcgccgcctacaggcccgccgcccgtcggagccagaggcggagggggcgccggggggagccgggcaccgccctgctggccccgctggtgctgagcctgggcctggcgctggcctgccttggcctcctgctggtcgtggtcagcctggggagctgggcaacgctgtctgcccaggagccttctcaggaggagctgacagcagaggaccgccgggagccccctgaactgaatccccagacagaggaaagccaggatgtggtacctttcttggaacaactagtccggcctcgaagaagtgctcctaaaggccggaaggcgcggcctcgccgagctattgcagcccattatgaggttcatcctcggccaggacaggatggagcacaagcaggtgtggatgggacagtgagtggctgggaagagaccaaaatcaacagctccagccctctgcgctacgaccgccagattggggaatttacagtcatcagggctgggctctactacctgtactgtcaggtgcactttgatgagggaaaggctgtctacctgaagctggacttgctggtgaacggtgtgctggccctgcgctgcctggaagaattctcagccacagcagcaagctctcctgggccccagctccgtttgtgccaggtgtctgggctgttgccgctgcggccagggtcttcccttcggatccgcaccctcccctgggctcatcttaaggctgcccccttcctaacctactttggactctttcaagttcactga

SEQ ID NO: 867-877 - skipped (11 entries)

SEQ ID NO: 878 - DNA, 2097 bp, Artificial Sequence
  LS-NbMMRm22.84-mCD28H-mCD28TM-mCD28CS-mCD3zICS-T2A-mtrCD19
atggagtggacctgggtgttcctgttcctgctgagcgtgaccgccggcgtgcacagccaggttcagctgcaagagtctggcggaggactggttcaacctggcggaagcctgagactgtcttgtgccgcttctggcagaaccttcagcaactacgtgaactacgccatgggctggttcagacagttccccggcaaagagagagagttcgtcgccagcatcagctggtctagcgtgaccacctactacgccgacagcgtgaagggcagattcaccatcagcagagacaacgccaagaacaccgtgtacctgcagatgaacagcctgaagccagaggacaccgccgtgtactactgtgctgctcacctggctcagtacagcgactacgcctacagagatccccaccagtttggcgcttggggccagggaacacaagtgaccgttagctctatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagggccagggccaaaaggtctggctccggtgagggcagaggaagtcttctaacatgcggtgacgtggaggagaatcccggccctatgccatctcctctgcctgtgtccttcctgctgttcctgacactcgtcggcggcagacctcagaagtctctgctggttgaggtggaagagggcggcaatgtggtgctgccttgtctgcctgatagcagccctgtgtccagcgagaagctggcttggtacagaggcaaccagagcaccccatttctggaactgagccctggctctcctggactgggactgcatgttggatctctgggcatcctgctggtcatcgtgaacgtgtccgatcacatgggcggcttctacctgtgccagaagaggcctccattcaaggacatctggcagcctgcctggaccgtgaacgttgaggatagcggcgagatgttcagatggaacgccagcgacgtgcgcgacctggactgtgacctgagaaacagaagcagcggcagccacagaagcacctctggctctcagctgtacgtgtgggccaaagatcaccccaaagtgtggggcaccaagcctgtgtgtgctcctagaggcagcagcctgaaccagagcctgatcaaccaggacctgacagtggctcctggcagcacactgtggctgtcttgcggagttcctccagtgcctgtggccaagggcagcatctcttggacacacgtgcaccctagaaggcccaacgtgtccctgctgtctctgtctctcggcggagaacatcccgtgcgcgagatgtgggtttggggatctcttctgctgctgccacaggccacagctctggatgagggcacctactactgcctgaggggcaacctgaccatcgagagacacgtgaaagtgatcgccagatccgccgtgtggctctggcttcttagaacaggcggatggatcgtgcccgtggtcaccctggtgtacgtgatcttctgcatggtgtccctggtggccttcctgtactgccagagagccttcatcctgagaagaaagcgcaagcggatgacctgatga

SEQ ID NO: 879 - DNA, 2100 bp, Artificial Sequence
  LS-NbMMRm5.38-mCD28H-mCD28TM-mCD28CS-mCD3zICS-T2A-mtrCD19
atggagtggacctgggtgttcctgttcctgctgagcgtgaccgccggcgtgcacagccaggttcagctgcaagagtctggcggaggactggttcaagctggcggaagcctgagactgtcttgtgccgcttctggcttcaccgacgacgactacgatatcggctggttcagacaggcccctggcaaagagagagagggcgtcagctgtatcagcagctctgacggctctacctactacgccgacagcgtgaagggcagattcaccatcagcagcgacaacgccaagaacaccgtgtacctgcagatgaactctctgaagcccgaggacaccgccgtgtactactgtgccgccgacttcttcagatgggacagcggcagctactacgtgcggggatgtagacacgccacctacgattactggggccagggcacacaagtgaccgtgtcatctatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagggccagggccaaaaggtctggctccggtgagggcagaggaagtcttctaacatgcggtgacgtggaggagaatcccggccctatgccatctcctctgcctgtgtccttcctgctgttcctgacactcgtcggcggcagacctcagaagtctctgctggttgaggtggaagagggcggcaatgtggtgctgccttgtctgcctgatagcagccctgtgtccagcgagaagctggcttggtacagaggcaaccagagcaccccatttctggaactgagccctggctctcctggactgggactgcatgttggatctctgggcatcctgctggtcatcgtgaacgtgtccgatcacatgggcggcttctacctgtgccagaagaggcctccattcaaggacatctggcagcctgcctggaccgtgaacgttgaggatagcggcgagatgttcagatggaacgccagcgacgtgcgcgacctggactgtgacctgagaaacagaagcagcggcagccacagaagcacctctggctctcagctgtacgtgtgggccaaagatcaccccaaagtgtggggcaccaagcctgtgtgtgctcctagaggcagcagcctgaaccagagcctgatcaaccaggacctgacagtggctcctggcagcacactgtggctgtcttgcggagttcctccagtgcctgtggccaagggcagcatctcttggacacacgtgcaccctagaaggcccaacgtgtccctgctgtctctgtctctcggcggagaacatcccgtgcgcgagatgtgggtttggggatctcttctgctgctgccacaggccacagctctggatgagggcacctactactgcctgaggggcaacctgaccatcgagagacacgtgaaagtgatcgccagatccgccgtgtggctctggcttcttagaacaggcggatggatcgtgcccgtggtcaccctggtgtacgtgatcttctgcatggtgtccctggtggccttcctgtactgccagagagccttcatcctgagaagaaagcgcaagcggatgacctgatga

SEQ ID NO: 880 - DNA, 2448 bp, Artificial Sequence
  LS-scFvP4A8VHVL-mCD28H-mCD28TM-mCD28CS-mCD3zICS-T2A-mtrCD19
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagggccagggccaaaaggtctggctccggtgagggcagaggaagtcttctaacatgcggtgacgtggaggagaatcccggccctatgccatctcctctgcctgtgtccttcctgctgttcctgacactcgtcggcggcagacctcagaagtctctgctggttgaggtggaagagggcggcaatgtggtgctgccttgtctgcctgatagcagccctgtgtccagcgagaagctggcttggtacagaggcaaccagagcaccccatttctggaactgagccctggctctcctggactgggactgcatgttggatctctgggcatcctgctggtcatcgtgaacgtgtccgatcacatgggcggcttctacctgtgccagaagaggcctccattcaaggacatctggcagcctgcctggaccgtgaacgttgaggatagcggcgagatgttcagatggaacgccagcgacgtgcgcgacctggactgtgacctgagaaacagaagcagcggcagccacagaagcacctctggctctcagctgtacgtgtgggccaaagatcaccccaaagtgtggggcaccaagcctgtgtgtgctcctagaggcagcagcctgaaccagagcctgatcaaccaggacctgacagtggctcctggcagcacactgtggctgtcttgcggagttcctccagtgcctgtggccaagggcagcatctcttggacacacgtgcaccctagaaggcccaacgtgtccctgctgtctctgtctctcggcggagaacatcccgtgcgcgagatgtgggtttggggatctcttctgctgctgccacaggccacagctctggatgagggcacctactactgcctgaggggcaacctgaccatcgagagacacgtgaaagtgatcgccagatccgccgtgtggctctggcttcttagaacaggcggatggatcgtgcccgtggtcaccctggtgtacgtgatcttctgcatggtgtccctggtggccttcctgtactgccagagagccttcatcctgagaagaaagcgcaagcggatgacctgatga

SEQ ID NO: 881 - DNA, 2448 bp, Artificial Sequence
  LS-scFvP4A8VLVH-mCD28H-mCD28TM-mCD28CS-mCD3zICS-T2A-mtrCD19
atggagtggacctgggtgttcctgttcctgctgagcgtgaccgccggcgtgcacagcgacattgtgctgacacagtctcctgcttccttagctgtatctctggggcagagggccaccatctcatgcagggccagcaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatgcactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagggccagggccaaaaggtctggctccggtgagggcagaggaagtcttctaacatgcggtgacgtggaggagaatcccggccctatgccatctcctctgcctgtgtccttcctgctgttcctgacactcgtcggcggcagacctcagaagtctctgctggttgaggtggaagagggcggcaatgtggtgctgccttgtctgcctgatagcagccctgtgtccagcgagaagctggcttggtacagaggcaaccagagcaccccatttctggaactgagccctggctctcctggactgggactgcatgttggatctctgggcatcctgctggtcatcgtgaacgtgtccgatcacatgggcggcttctacctgtgccagaagaggcctccattcaaggacatctggcagcctgcctggaccgtgaacgttgaggatagcggcgagatgttcagatggaacgccagcgacgtgcgcgacctggactgtgacctgagaaacagaagcagcggcagccacagaagcacctctggctctcagctgtacgtgtgggccaaagatcaccccaaagtgtggggcaccaagcctgtgtgtgctcctagaggcagcagcctgaaccagagcctgatcaaccaggacctgacagtggctcctggcagcacactgtggctgtcttgcggagttcctccagtgcctgtggccaagggcagcatctcttggacacacgtgcaccctagaaggcccaacgtgtccctgctgtctctgtctctcggcggagaacatcccgtgcgcgagatgtgggtttggggatctcttctgctgctgccacaggccacagctctggatgagggcacctactactgcctgaggggcaacctgaccatcgagagacacgtgaaagtgatcgccagatccgccgtgtggctctggcttcttagaacaggcggatggatcgtgcccgtggtcaccctggtgtacgtgatcttctgcatggtgtccctggtggccttcctgtactgccagagagccttcatcctgagaagaaagcgcaagcggatgacctgatga

SEQ ID NO: 882 - DNA, 2448 bp, Artificial Sequence
  LS-scFvP3G5VHVL-mCD28H-mCD28TM-mCD28CS-mCD3zICS-T2A-mtrCD19
atggagtggacctgggtgttcctgttcctgctgagcgtgaccgccggcgtgcacagccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaggtggtggtggttctggcggcggcggctccggtggtggtggttccgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagggccagggccaaaaggtctggctccggtgagggcagaggaagtcttctaacatgcggtgacgtggaggagaatcccggccctatgccatctcctctgcctgtgtccttcctgctgttcctgacactcgtcggcggcagacctcagaagtctctgctggttgaggtggaagagggcggcaatgtggtgctgccttgtctgcctgatagcagccctgtgtccagcgagaagctggcttggtacagaggcaaccagagcaccccatttctggaactgagccctggctctcctggactgggactgcatgttggatctctgggcatcctgctggtcatcgtgaacgtgtccgatcacatgggcggcttctacctgtgccagaagaggcctccattcaaggacatctggcagcctgcctggaccgtgaacgttgaggatagcggcgagatgttcagatggaacgccagcgacgtgcgcgacctggactgtgacctgagaaacagaagcagcggcagccacagaagcacctctggctctcagctgtacgtgtgggccaaagatcaccccaaagtgtggggcaccaagcctgtgtgtgctcctagaggcagcagcctgaaccagagcctgatcaaccaggacctgacagtggctcctggcagcacactgtggctgtcttgcggagttcctccagtgcctgtggccaagggcagcatctcttggacacacgtgcaccctagaaggcccaacgtgtccctgctgtctctgtctctcggcggagaacatcccgtgcgcgagatgtgggtttggggatctcttctgctgctgccacaggccacagctctggatgagggcacctactactgcctgaggggcaacctgaccatcgagagacacgtgaaagtgatcgccagatccgccgtgtggctctggcttcttagaacaggcggatggatcgtgcccgtggtcaccctggtgtacgtgatcttctgcatggtgtccctggtggccttcctgtactgccagagagccttcatcctgagaagaaagcgcaagcggatgacctgatga

SEQ ID NO: 883 - DNA, 2448 bp, Artificial Sequence
  LS-scFvP3G5VLVH-mCD28H-mCD28TM-mCD28CS-mCD3zICS-T2A-mtrCD19
atggagtggacctgggtgttcctgttcctgctgagcgtgaccgccggcgtgcacagcgacattgtgctgacacagtctcctgcttccttagctgtatctctggggcagagggccaccatctcatgcagggccaacaaaagtgtcagtacatctagctatagttatatgcactggtaccaacagaaaccaggacagccacccaaactcctcatcaagtatgcatccaacctagaatctggggtccctgccaggttcagtggcagtgggtctgggacagacttcatcctcaacatccatccagtggaggaggaggatgctgcaacctattactgtcagcacagtagggagcttccattcacgttcggctcggggacaaagttggaaataaaaggtggtggtggttctggcggcggcggctccggtggtggtggttcccaggtccagctgcagcagtctgggcctgaggtggtgaggcctggggtctcagtgaagatttcctgcaagggttccggctacacattcactgattatggtatacactgggtgaagcagagtcatgcaaagagtctagagtggattggagttattagtacttacaatggttatacaaactacaaccagaagtttaagggcaaggccacaatgactgtagacaaatcctccagcacagcctatatggaacttgccagattgacatctgaggattctgccatctattactgtgcaagagcctactatggtaacctttactatgctatggactactggggtcaaggaacctcagtcaccgtctcctcaatcaaggagaagcacctgtgccacacccagagcagccccaagctgttctgggccctggtggtggtggccggcgtgctgttctgctacggcctgctggtgaccgtggccctgtgcgtgatctggaccaacagcaggaggaacaggctgctgcagagcgactacatgaacatgacccccaggaggcccggcctgaccaggaagccctaccagccctacgcccccgccagggacttcgccgcctacaggcccagggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccagggccagggccaaaaggtctggctccggtgagggcagaggaagtcttctaacatgcggtgacgtggaggagaatcccggccctatgccatctcctctgcctgtgtccttcctgctgttcctgacactcgtcggcggcagacctcagaagtctctgctggttgaggtggaagagggcggcaatgtggtgctgccttgtctgcctgatagcagccctgtgtccagcgagaagctggcttggtacagaggcaaccagagcaccccatttctggaactgagccctggctctcctggactgggactgcatgttggatctctgggcatcctgctggtcatcgtgaacgtgtccgatcacatgggcggcttctacctgtgccagaagaggcctccattcaaggacatctggcagcctgcctggaccgtgaacgttgaggatagcggcgagatgttcagatggaacgccagcgacgtgcgcgacctggactgtgacctgagaaacagaagcagcggcagccacagaagcacctctggctctcagctgtacgtgtgggccaaagatcaccccaaagtgtggggcaccaagcctgtgtgtgctcctagaggcagcagcctgaaccagagcctgatcaaccaggacctgacagtggctcctggcagcacactgtggctgtcttgcggagttcctccagtgcctgtggccaagggcagcatctcttggacacacgtgcaccctagaaggcccaacgtgtccctgctgtctctgtctctcggcggagaacatcccgtgcgcgagatgtgggtttggggatctcttctgctgctgccacaggccacagctctggatgagggcacctactactgcctgaggggcaacctgaccatcgagagacacgtgaaagtgatcgccagatccgccgtgtggctctggcttcttagaacaggcggatggatcgtgcccgtggtcaccctggtgtacgtgatcttctgcatggtgtccctggtggccttcctgtactgccagagagccttcatcctgagaagaaagcgcaagcggatgacctgatga

SEQ ID NO: 884 - DNA, 2271 bp, Artificial Sequence
  mCD3zICS-mCD28CS-mTWEAK-T2A-mtrCD19
agggccaagttcagcaggagcgccgagaccgccgccaacctgcaggaccccaaccagctgtacaacgagctgaacctgggcaggagggaggagtacgacgtgctggagaagaagagggccagggaccccgagatgggcggcaagcagcagaggaggaggaacccccaggagggcgtgtacaacgccctgcagaaggacaagatggccgaggcctacagcgagatcggcaccaagggcgagaggaggaggggcaagggccacgacggcctgtaccagggcctgagcaccgccaccaaggacacctacgacgccctgcacatgcagaccctggcccccaggaacagcaggaggaacaggctgctgcagagcgactacatgaacatgacccccaggaggcccggcctgaccaggaagccctaccagccctacgcccccgccagggacttcgccgcctacaggcccgccgcccgtcggagccagaggcggagggggcgccggggggagccgggcaccgccctgctggccccgctggtgctgagcctgggcctggcgctggcctgccttggcctcctgctggtcgtggtcagcctggggagctgggcaacgctgtctgcccaggagccttctcaggaggagctgacagcagaggaccgccgggagccccctgaactgaatccccagacagaggaaagccaggatgtggtacctttcttggaacaactagtccggcctcgaagaagtgctcctaaaggccggaaggcgcggcctcgccgagctattgcagcccattatgaggttcatcctcggccaggacaggatggagcacaagcaggtgtggatgggacagtgagtggctgggaagagaccaaaatcaacagctccagccctctgcgctacgaccgccagattggggaatttacagtcatcagggctgggctctactacctgtactgtcaggtgcactttgatgagggaaaggctgtctacctgaagctggacttgctggtgaacggtgtgctggccctgcgctgcctggaagaattctcagccacagcagcaagctctcctgggccccagctccgtttgtgccaggtgtctgggctgttgccgctgcggccagggtcttcccttcggatccgcaccctcccctgggctcatcttaaggctgcccccttcctaacctactttggactctttcaagttcactgagccagggccaaaaggtctggctccggtgagggcagaggaagtcttctaacatgcggtgacgtggaggagaatcccggccctatgccatctcctctgcctgtgtccttcctgctgttcctgacactcgtcggcggcagacctcagaagtctctgctggttgaggtggaagagggcggcaatgtggtgctgccttgtctgcctgatagcagccctgtgtccagcgagaagctggcttggtacagaggcaaccagagcaccccatttctggaactgagccctggctctcctggactgggactgcatgttggatctctgggcatcctgctggtcatcgtgaacgtgtccgatcacatgggcggcttctacctgtgccagaagaggcctccattcaaggacatctggcagcctgcctggaccgtgaacgttgaggatagcggcgagatgttcagatggaacgccagcgacgtgcgcgacctggactgtgacctgagaaacagaagcagcggcagccacagaagcacctctggctctcagctgtacgtgtgggccaaagatcaccccaaagtgtggggcaccaagcctgtgtgtgctcctagaggcagcagcctgaaccagagcctgatcaaccaggacctgacagtggctcctggcagcacactgtggctgtcttgcggagttcctccagtgcctgtggccaagggcagcatctcttggacacacgtgcaccctagaaggcccaacgtgtccctgctgtctctgtctctcggcggagaacatcccgtgcgcgagatgtgggtttggggatctcttctgctgctgccacaggccacagctctggatgagggcacctactactgcctgaggggcaacctgaccatcgagagacacgtgaaagtgatcgccagatccgccgtgtggctctggcttcttagaacaggcggatggatcgtgcccgtggtcaccctggtgtacgtgatcttctgcatggtgtccctggtggccttcctgtactgccagagagccttcatcctgagaagaaagcgcaagcggatgacctgatga

What is claimed is:

1. A method of therapy, comprising administering to the skin of a subject suffering from systemic sclerosis (SSc) an effective amount of a T cell or T cells which express a chimeric antigen receptor (CAR) comprising:

(a) an antigen-binding (AB) domain that binds to Cluster of Differentiation (CD) 206 (CD206), (b) a transmembrane (TM) domain, comprising an amino acid sequence at least 90% identical to Seq ID No. 146 or 746;

(c) an intracellular signaling (ICS) domain derived from CD3ζ, which comprises an amino acid sequence 90% identical to Seq ID NOs: 147 or 747;

(d) a hinge that joins said AB domain and said TM domain, which comprises an amino sequence at least 90% identical to SEQ ID NOs: 145 or 745; and (e) one or more costimulatory (CS) domains derived from CD28, 4-1BB, or DAP10, which comprises an amino acid sequence 90% identical to Seq ID NOs: 156, 157, 158; thereby treating the SSc, wherein the CAR does not comprise an inhibitory receptor signaling domain and the T cell or T cells do not express an inhibitory CAR, wherein the CAR consists of one of the amino acid sequences selected from the group consisting of SEQ ID NOs: 160, 166, 172, 760, 161, 167, 173, and 761.

2. A method of therapy according to claim 1, wherein said T cell or T cells is/are selected from the group consisting of a CD8+ T cell, a CD4+ T cell, a helper T (Th) cell, a regulatory T cell, a naive T cell, an effector T cell, a memory T cell, a stem cell memory T (TSCM) cell, a central memory T (TCM) cell, an effector memory T (TEM) cell, a terminally differentiated effector memory T cell, a tumor-infiltrating lymphocyte (TIL), a cytotoxic T cell, a mucosa-associated invariant T (MAIT) cell, a Th1 cell, a Th2 cell, a Th3 cell, a Thl7 cell, a Th9 cell, a Th22 cell, a follicular helper T cell, and a Natural Killer T (NKT) cell.

3. A method of therapy according to claim 1, wherein the effective amount of T cell or T cells are administered in combination with a fibrotic disease-modulatory molecule (FDMM) or further engineered to express a FDMM, wherein the FDMM is selected from the group consisting of glutaredoxin (GRX), glutathione S-transferase pi (GSTP), interleukin (IL)-37, IL-12, tumor necrosis factor (TNF)-α, interferon (IFN)-γ, C—C chemokine ligand 2 (CCL2), and TNF-α-induced protein 3 (TNFAIP3).

4. A method of therapy according to claim 1, wherein the subject is a human.

5. A method of therapy according to claim 1, wherein said AB domain comprises an antibody or an antigen-binding fragment thereof selected from the group consisting of a humanized antibody, a single chain antibody, a single-domain antibody (dAb), a chimeric antibody, a fragment antigen-binding (Fab), an F(ab')2, an Fab' fragment, a variable fragment (Fv), a single-chain Fv (scFv) fragment, an Fd fragment, a diabody, a nanobody, a bivalent nanobody, a camelid Ab, and a minibody.

6. A method of therapy according to claim 1, wherein said T cell or T cells have been modified such that its endogenous TCR is not expressed, is not functionally expressed, or is expressed at reduced levels compared to a wild-type T cell.

7. A method of therapy according to claim 1, wherein the effective amount of T cell or T cells are administered intradermally.

8. A method of therapy according to claim 1, wherein the AB domain comprise an immunoglobulin heavy chain variable domain (VH), wherein the amino acid sequence of the VH consists of SEQ ID NO: 110; or SEQ ID NO: 114.

* * * * *